US 11,162,108 B2

(12) United States Patent
Wu et al.

(10) Patent No.: US 11,162,108 B2
(45) Date of Patent: Nov. 2, 2021

(54) TRANSGENIC PLANTS HAVING INCREASED BIOMASS

(71) Applicant: Ceres, Inc., Thousand Oaks, CA (US)

(72) Inventors: Chuan-Yin Wu, Newbury Park, CA (US); Han-Suk Kim, Camarillo, CA (US); Gerard Magpantay, Canoga Park, CA (US); Fasong Zhou, Fremont, CA (US); Julissa Sosa, Northridge, CA (US); Gregory Nadzan, Thousand Oaks, CA (US); Roger I. Pennell, Malibu, CA (US); Mircea Achiriloaie, Thousand Oaks, CA (US); Wuyi Wang, Newbury Park, CA (US)

(73) Assignee: Ceres, Inc., Thousand Oaks, CA (US)

(*) Notice: Subject to any disclaimer, the term of this patent is extended or adjusted under 35 U.S.C. 154(b) by 0 days.

(21) Appl. No.: 15/676,845

(22) Filed: Aug. 14, 2017

(65) Prior Publication Data

US 2018/0079789 A1 Mar. 22, 2018

Related U.S. Application Data

(63) Continuation of application No. 13/385,000, filed as application No. PCT/US2010/042602 on Jul. 20, 2010, now abandoned.

(60) Provisional application No. 61/226,969, filed on Jul. 20, 2009.

(51) Int. Cl.
*C12N 15/82* (2006.01)

(52) U.S. Cl.
CPC ........ *C12N 15/8261* (2013.01); *Y02A 40/146* (2018.01)

(58) Field of Classification Search
None
See application file for complete search history.

(56) References Cited

U.S. PATENT DOCUMENTS

| 4,987,071 | A | 1/1991 | Cech et al. |
| 5,034,323 | A | 7/1991 | Jorgensen et al. |
| 5,204,253 | A | 4/1993 | Sanford et al. |
| 5,231,020 | A | 7/1993 | Jorgensen et al. |
| 5,254,678 | A | 10/1993 | Haseloff et al. |
| 5,538,880 | A | 7/1996 | Lundquist et al. |
| 5,766,847 | A | 6/1998 | Jackie et al. |
| 6,013,863 | A | 1/2000 | Lundquist et al. |
| 6,326,527 | B1 | 12/2001 | Kirihara et al. |
| 6,329,571 | B1 | 12/2001 | Hiei |
| 6,423,885 | B1 | 7/2002 | Waterhouse et al. |
| PP13,008 | P2 | 9/2002 | Walsh |
| 6,452,067 | B1 | 9/2002 | Bedbrook et al. |
| 6,573,099 | B2 | 6/2003 | Graham |
| PP14,743 | P2 | 5/2004 | Speichert et al. |
| 6,753,139 | B1 | 6/2004 | Baulcombe et al. |
| 6,777,588 | B2 | 8/2004 | Waterhouse et al. |
| PP15,193 | P2 | 9/2004 | Smith et al. |
| 6,906,244 | B2 | 6/2005 | Fischer et al. |
| PP16,176 | P3 | 1/2006 | Cosner et al. |
| 7,214,789 | B2 | 5/2007 | Pennell |
| PP18,161 | P2 | 10/2007 | Probst |
| 7,312,376 | B2 | 12/2007 | Apuya et al. |
| 7,378,571 | B2 | 5/2008 | Apuya |
| 7,402,667 | B2 | 7/2008 | Cook et al. |
| 7,429,692 | B2 | 9/2008 | Chan |
| 7,445,654 | B2 | 11/2008 | Wong |
| 7,598,367 | B2 | 10/2009 | Cook et al. |
| 2003/0175783 | A1 | 9/2003 | Waterhouse et al. |
| 2003/0175965 | A1 | 9/2003 | Lowe et al. |
| 2003/0180945 | A1 | 9/2003 | Wang et al. |
| 2004/0123343 | A1 | 6/2004 | La Rosa et al. |
| 2004/0172684 | A1 | 9/2004 | Kovalic et al. |
| 2004/0214330 | A1 | 10/2004 | Waterhouse et al. |
| 2005/0032221 | A1 | 2/2005 | Chang et al. |
| 2005/0097638 | A1 | 5/2005 | Jiang et al. |
| 2006/0015970 | A1 | 1/2006 | Pannell et al. |
| 2006/0021083 | A1 | 1/2006 | Cook |
| 2006/0041952 | A1 | 2/2006 | Cook |
| 2006/0150283 | A1* | 7/2006 | Alexandrov ......... C07K 14/415 800/288 |
| 2006/0162006 | A9 | 7/2006 | Sherman et al. |
| 2006/0260004 | A1 | 11/2006 | Fang et al. |
| 2006/0265788 | A1 | 11/2006 | Rommens |
| 2007/0006335 | A1 | 1/2007 | Cook |
| 2007/0006346 | A1 | 1/2007 | Nickolai et al. |

(Continued)

FOREIGN PATENT DOCUMENTS

WO WO 1997/001952 1/1997
WO WO 1998/036083 8/1998

(Continued)

OTHER PUBLICATIONS

Zhao et al. (2004) "Overexpression of LSH1, a member of an uncharacterized gene family, causes enhanced light regulation of seedling development," Plant J 37:694-706.*
Londo et al. (2006) Proc Natl Acad Sci USA 103(25):9578-83.*
Hong et al. (2010) J Genet Genom 37:101-15.*
Press & Queitsch (2017) Genet 205:455-64.*
Olsen et al. (2005) Trends Plant Sci 10(2):79-87.*
Guo et al. (2004) Proc Natl Acad Sci USA 101:9205-10.*
Mendonça Vilela et al. (2017) Genome Biol Evol 9(2):266-78.*
Zhang (2003) Curr Opin Plant Biol 6:430-40.*
Batemann et al., Acta Cryst. (2010) F66:1148-52.*
Tittonell et al. (2005) Agric Ecosys & Environ 105:213-20.*
Whisstock & Lesk (2003) Q Rev Biophys. 36(3):307-40.*
Committee Nat'l Acad Sci, Genetically Engineered Crops through 2015 (2016).*

(Continued)

Primary Examiner — Russell T Boggs
(74) Attorney, Agent, or Firm — Dentons US LLP

(57) ABSTRACT

Methods and materials for modulating biomass levels in plants are disclosed. For example, nucleic acids encoding biomass-modulating polypeptides are disclosed as well as methods for using such nucleic acids to transform plant cells. Also disclosed are plants having increased biomass levels and plant products produced from plants having increased biomass levels.

11 Claims, 31 Drawing Sheets

Specification includes a Sequence Listing.

(56) References Cited

U.S. PATENT DOCUMENTS

| | | |
|---|---|---|
| 2007/0020621 A1 | 1/2007 | Boukharov et al. |
| 2007/0039067 A1 | 2/2007 | Feldmann et al. |
| 2007/0056058 A1 | 3/2007 | Olivier et al. |
| 2007/0079400 A1 | 4/2007 | Allen et al. |
| 2007/0192900 A1 | 8/2007 | Sticklen |
| 2008/0148432 A1 | 6/2008 | Abad |
| 2009/0144847 A1 | 6/2009 | Shaikh et al. |
| 2009/0158452 A1 | 6/2009 | Johnson et al. |
| 2009/0183270 A1 | 7/2009 | Adams et al. |
| 2011/0167514 A1 | 7/2011 | Brover et al. |

FOREIGN PATENT DOCUMENTS

| | | |
|---|---|---|
| WO | WO 1998/053083 | 11/1998 |
| WO | WO 1999/032619 | 7/1999 |
| WO | WO 2002/046449 | 6/2002 |
| WO | WO 2003/013227 | 2/2003 |
| WO | WO 2005/098007 | 10/2005 |
| WO | WO 2006/005023 | 1/2006 |
| WO | WO 2006/034479 | 3/2006 |
| WO | WO 2006/036864 | 4/2006 |
| WO | 2007/031581 A2 * | 3/2007 |
| WO | WO 2007/031581 A2 * | 3/2007 |
| WO | WO 2007/044988 | 4/2007 |
| WO | WO 2007/055826 | 5/2007 |
| WO | WO 2007/120989 | 10/2007 |
| WO | WO 2008/006033 | 1/2008 |
| WO | WO2008/006033 A1 * | 1/2008 |
| WO | WO 2008/006033 A1 * | 1/2008 |
| WO | WO 2008/049183 | 5/2008 |
| WO | WO 2009/056566 | 5/2009 |
| WO | WO 2009/073069 | 6/2009 |
| WO | WO 2009/092009 | 7/2009 |

OTHER PUBLICATIONS

Zeigler & Barclay (2008) Rice 1:3-10.*
Gravois & McNew (1993) Crop Sci 33:249-52.*
GenBank Accession No. BT014677, dated May 21, 2004.
UniProtKB/Swiss-Prot Accession No. Q9SN52, dated Nov. 7, 2018.
European Extended Search Report regarding European Application No. 18192860, dated Nov. 15, 2018.
GenBank Accession No. AAV98701, dated Oct. 16, 2006.
U.S. Appl. No. 60/505,689, filed Sep. 23, 2003, Cook et al.
U.S. Appl. No. 60/518,075, filed Nov. 6, 2003, Pennell et al.
U.S. Appl. No. 60/544,771, filed Feb 13, 2004, Cook et al.
U.S. Appl. No. 60/558,869, filed Apr. 1, 2004, Cook et al.
U.S. Appl. No. 60/583,609, filed Jun. 30, 2004, Alexandrov.
U.S. Appl. No. 60/583,691, filed Jun. 30, 2004, Alexandrov et al.
U.S. Appl. No. 60/612,891, filed Sep. 23, 2004, Kwok.
U.S. Appl. No. 60/637,140, filed Dec. 16, 2004, Feldmann.
U.S. Appl. No. 60/757,544, filed Jan. 9, 2006, Dang.
U.S. Appl. No. 60/776,307, filed Feb. 24, 2006, Kwok.
Office Action regarding European Application No. 13176038, dated Dec. 16, 2016.
Olsen et al., *Trends Plant Sci.*,10(2):79-87, 2005.
Guo et al., *Proc. Natl. Acad. Sci. USA*, 101:9205-10, 2004.
Zhang, *Curr. Opin. Plant Biol.*, 6:430-40, 2003.
Whisstock & Lesk, *Q Rev Biophys.*, 36(3):307-40, 2003.
Yanagisawa, *Trends Plant Sci.*, 7(12)555-60, 2002.
Kovalchuk_EMBO_J_19_17_4431_2000.
HMM_SEQ ID No. 319 Is 08082014.
4B755_08082014.
SEQ ID No. 319 v K4B755_08082014.
SEQ ID No. 319 v SEQ ID No. 263_08052014.
Guo Proc Natl Acad Sci 101 9205 2004.
Chawade_BMC Gnmcs_8_304_2007.
WhisstockQ Rev Biophys_36_307_2003.
Extended European Search Report in EP Application No. 10802777. 2, dated Feb. 14, 2013, 9 pages.
Extended European Search Report in EP Application No. 13176038. 1, dated Oct. 4, 2013, 6 pages.
Authroized Officer S. Baharlou, International Preliminary Report on Patentability in International Application No. PCT/US2010/042602, dated Feb. 2, 2012, 7 pages.
Authorized Officer K. Kim, International Search Report and Written Opinion in International Application No. PCT/US2010/042602, dated Feb. 28, 2011, 13 pages.
Abler et al., "Isolation and characterization of a genomic sequence encoding the maize Cat3 catalase gene," *Plant Mol. Biol.*, 22:10131-1038, 1993.
Akashi et al., "Gene Discovery by Ribozyme and siRNA Libraries," *Nature Rev Mol. Cell Biol.*, 6:413-422, 2005.
Alonso-Blanco et al., "The Use of Recombinant Inbred Lines (RILs) for Genetic Mapping," *Arabidopsis Protocols*, 82:137-146, 1998.
Baerson et al., "Developmental regulation of an acyl carrier protein promoter in vegetative and reproductive tissues," *Plant Mol. Biol.*, 22(2):255-267, 1993.
Bateman et al., "Pfam 3.1: 1313 multiple alignments and profiled HMMs match the majority of proteins," *Nucl. Acids Res.*, 27:260-262, 1999.
Braga et al., "Expression of the CrylAb Protein in Genetically Modified Sugarcane for the Control of *Diatraea saccharalis* (Lepidoptera: Crambidae)," *Journal of New Seeds*, 5:209-221, 2003.
Burr et al., "Mapping Genes Inbreds," *The Maize Handbook* (New York, NY, 249-254, 1994.
Burr et al., "Gene Mapping with Recombinant Inbreds in Maize," *Genetics*, 118:519-526, 1998.
Bustos et al., "Regulation of β-Glucuronidase Expression in Transgenic Tobacco Plants by an A/T-Rich, cis-Acting Sequence Found Upstream of a French Bean β-Phaseolin Gene," *Plant Cell*, 1(9):839-853, 1989.
Cerdan et al., "A 146 bp fragment of the tobacco Lhcbl*2 promoter confers very-low-fluence, low-fluence and high-irradiance responses of phytochrome to a minimal CaMV 35S promoter," *Plant Mol. Biol.*, 33:245-255, 1997.
Chen et al., "Functional analysis of regulatory elements in a plant embryo-specific gene," *Proc. Natl. Acad. Sci. USA*, 83:8560-8564, 1986.
Chenna et al., "Multiple sequence alignment with the Clustal series of programs," *Nucleic Acids Res.*, 31(13):3497-3500, 2003.
Conceicao et al., "A cotyledon regulatory region is responsible for the different spatial expression patterns of *Arabidopsis* 2S albumin genes," *Plant*, 5:493-505, 1994.
Conkling et al., "Isolation of Transcriptionally Regulated Root-Specific Genes from Tobacco," *Plant Physiol.*, 93:1203-1211, 1990.
Dai et al., "RF2b, a rice bZIP transcription activator, interacts with RF2a and is involved in symptom development of rice tungro disease," *Proc. Natl. Acad. Sci. USA*, 101(2):687-692, 2004.
de Feyter et al., Expressing Ribozymes in Plants, *Methods in Molecular Biology*, 4(43):403-415, 1997.
Do et al., "ProbCons: Probabilistic consistency-based multiple sequence alignment," *Genome Res.*, 15(2):330-40, 2005.
Durbin et al., Biological Sequence Analysis: Probabilistic Models of Proteins and Nucleic Acids, Cambridge University Press, Cambridge, UK, 366 pages, 1998.
Fejes et al., "A 268 bp upstream sequence mediates the circadian clock-regulated transcription of the wheat Cab-1 gene in transgenic plants," *Plant Mol. Biol.*, 15:921-932, 1990.
Fromm et al., "An Octopine Synthase Enhancer Element Directs Tissue-Specific Expression and Binds ASF-1, a Factor from Tobacco Nuclear Extracts," *Plant Cell*, 1:977-984, 1989.
Gardiner et al., "Development of a Core RFLP Map in Maize Using an Immortalized $F_2$ Population," *Genetics*, 134:917-930, 1993.
GenBank No. AF096096, 1999, 2 pages.
GenBank No. AFI29516, 1999, 2 pages.
GenBank No. L05934, 1993, 3 pages.
GenBank No. U93215, 2002, 42 pages.
Green et al., "Binding site requirements for pea nuclear protein factor GT-1 correlate with sequences required for light-dependent transcriptional activation of the rbcS-3A gene," *EMBO J.*, 7:4035-4044, 1988.

(56) References Cited

OTHER PUBLICATIONS

Hong et al., "Promoter sequences for two different *Brassica napus* tapetal oleosin-like genes direct tapetal expression of β-glucuronidase in transgenic *Brassica* plants," *Plant Mol. Biol.*, 34(3):549-555, 1997.

Horton et al., "Protein Subcellular Localization Prediction with WoLF PSORT," *Proceedings of the 4th Annual Asia Pacific Bioinformatics Conference*, 39-48, 2006.

Horton et al., "WoLF PSORT: Protein Localization Predictor," *Nucl. Acids Res.*, W585-W587, 2007.

Hwang et al., "Aleurone- and embryo-specific expression of the β-glucuronidase gene controlled by the barley Chi26 and Ltp1 promoters in transgenic rice," *Plant Cell Rep.*, 20:647-654, 2001.

Hyrup et al., "Peptide Nucleic Acids (PNA): Synthesis, Properties and Potential Applications," *Bioorgan. Med. Chem.*, 4:5-23, 1996.

Jordano et al., "A Sunflower Helianthinin Gene Upstream Sequence Ensemble Contains an Enhancer and Sites of Nuclear Protein Interaction," *Plant Cell*,1:855-866, 1989.

Kasuga et al., "Improving plant drought, salt and freezing tolerance by gene transfer of a single stress-inducible transcription factor," *Nature Biotech*, 17:287-291, 1999.

Keller et al., "Vascular-Specific Expression of the Bean GRP 1.8 Gene is Negatively Regulated," *Plant Cell*, 3(10):1051-1061, 1991.

Lam et al., "Site-specific mutations alter in vitro factor binding and change promoter expression pattern in transgenic plants," *Proc. Natl. Acad. Sci. USA*, 86:7890-7894, 1989.

Li et al., "Small dsRNAs induce transcriptional activation in human cells," *Proc. Natl. Acad. Sci. USA*, 103(46):17337-17342, 2006.

Lloyd et al., "Targeted mutagenesis using zinc-finger nucleases in *Arabidopsis,*" *Proc. Natl. Acad. Sci. USA*, 102:2232-2237, 2005.

Luan et al., "A Rice cab Gene Promoter Contains Separate cis-Acting Elements that regulate expression in Dicot and Monocot Plants," *Plant Cell*, 4:971-981, 1992.

Lubberstedt et al., "Promoters from Genes for Plastid Proteins Possess Regions with Different Sensitivities toward Red and Blue Light," *Plant Physiol.*, 104:997-1006, 1994.

Matsuoka et al., "Tissue-specific light-regulated expression directed by the promoter of a $C_4$ gene, maize pyruvate, orthophosphate dikinase, in a $C_3$ plant, rice," *Proc. Natl. Acad. Sci. USA*, 90:9586-9590, 1993.

Matzke et al., "RNAi-Mediated Pathways in the Nucleus," *Nature Reviews Genetics*, 6:24-35, 2005.

McCallum et al., "Targeted screening for induced mutations," *Nat Biotech.*, 18: 455-457, 2000.

Medberry et al., "The Commelina Yellow Mottle Virus Promoter is a Strong Promoter in Vascular and Reproductive Tissues," *Plant Cell*, 4(2):185-192, 1992.

Meier et al., "Elicitor-Inducible and Constitutive in Vivo DNA Footprints Indicate Novel cis-Acting Elements in the Promoter of a Parsley Gene encoding Pathogenesis-Related Protein 1," *Plant Cell*, 3:309-316, 1991.

Mittal, "Improving the efficiency of RNA interference in mammals," *Nature Reviews Genetics*, 5:355-365, 2004.

Perriman et al., "Effective ribozyme delivery in plant cells," *Proc. Natl. Acad. Sci. USA*, 92(13):6175-6179, 1995.

Refseth et al., "Hybridization capture of microsatellites directly from genomic DNA," *Electrophoresis*, 18:1519-1523, 1997.

Riggs et al., "Cotyledone Nuclear Proteins Bind to DNA Fragments Harboring Regulatory Elements of Phytohemagglutinin Genes," *Plant Cell*, 1(6):609-621, 1989.

Rivera et al., "Genomic evidence for two functionally distinct gene classes," *Proc. Natl. Acad. Sci. USA*, 95:6239-6244, 1998.

Seo et al., "Jasmonic acid carboxyl methyltransferase: A key enzyme for jasmonate-regulated plant responses," *PNAS*, 98(8):4788-4793, 2001.

Sheridan et al., "The mac1 Gene: Controlling the Commitment to the Meiotic Pathway in Maize," *Genetics*, 142:1009-1020, 1996.

Shinshi, "Ethylene-regulated transcription and crosstalk with jasmonic acid," *Plant Science*, 175:18-23, 2008.

Shizuya et al., "Cloning and stable maintenance of 300-kilobase-pair fragments of human DNA in *Escherichia coli* using an F-factor-based vector," *Proc. Natl. Acad. Sci. USA*, 106(5):1660-1665, 2009.

Slocombe et al., "Temporal and Tissue-Specific Regulation of a *Brassica napus* Stearoyl-Acyl Carrier Protein Desaturase Gene," *Plant Physiol.*, 104(4):167-176, 1994.

Sonnhammer et al., "Pfam: A Comprehensive Database of Protein Domain Families Based on Seed Alignments," *Proteins*, 28:405-420, 1997.

Sonnhammer et al., "Pfam: multiple sequence alignments and HMM-profiles of protein domains," *Nucl. Acids Res.*, 26:320-322, 1998.

Stemple, "TILLING—a high-throughput harvest for functional genomics," *Nat. Rev. Genet.*, 5(2):145-50, 2004.

Summerton et al., "Morpholino Antisense Oligomers: Design, Preparation, and Properties," *Antisense Nucleic Acid Drug Dev.*, 7:187-195, 1997.

Sun et al., "Crosstalk between jasmonic acid, ethylene and Nod factor signaling allows integration of diverse inputs for regulations of nodulation," *Plant J*, 46:961-970, 2006.

Tovkach et al., "A Toolbox and procedural notes for characterizing novel zinc finger nucleases for genome editing in plant cells," *Plant J*, 57:747-757, 2009.

Townsend et al., "High-frequency modification of plant genes using engineered zinc-finger nucleases," *Nature*, 459:442-445, 2009.

Truernit et al., "The promoter of the *Arabidopsis thaliana* SUC2 sucrose-H$^+$ symporter gene directs expression of β-glucuronidase to the phloem: Evidence for phloem: loading and unloading by SUC2," *Planta*, 196:564-570, 1995.

Urao et al., "Molecular cloning and characterization of a gene that encodes a MYC-related protein in *Arabidopsis,*" *Plant Mol. Biol.*, 32:571-57, 1996.

Watanabe et al., "Mechanism of Substrate Recognition and PLP-induced Conformational Changes in LL-Diaminopimelate aminotransferase from *Arabidopsis thaliana,*" *J Mol. Biol.*, 384:1314-1329, 2008.

Weigel et al., "Activation Tagging in *Arabidopsis,*" *Plant Physiology*, 122:1003-1013, 2000.

Yamamoto et al., "The Promoter of a Pine Photosynthetic Gene Allows Expression of a β-Glucuronidase Reporter Gene in Transgenic Rice Plants in a Light-Independent but Tissue-Specific Manner," *Plant Cell Physiol.*, 1994, 35:773-778, 1994.

Yan et al., "New Construct Approaches for Efficient Gene Silencing in Plants," *Plant Physiol.*, 141:1508-1518, 2006.

Zhang et al., "DNA Sequences that Activate Isocitrate Lyase Gene Expression during Late Embryogenesis and during Postgerminative Growth," *Plant Physiology*, 110:1069-1079, 1996.

Zhang et al., "From Laboratory to Field. Using Information From *Arabidopsis* to Engineer Salt, Cold, and Drought Tolerance in Crops," *Plant Physiol.*, 135:615-621, 2004.

Zheng et al., "SPK1 is an Essential S-Phase-Specific Gene of *Saccharomyces cerevisiae* that Encodes a Nuclear Serin/Threonine/Tyrosine Kinase," *Mol. Cell Biol.*, 13:5829-5842, 1993.

GenBank Accession No. BT064583.1, dated Feb. 21, 2009.

\* cited by examiner

| | | | | | |
|---|---|---|---|---|---|
| SEQ_ID_NO_263 | YPVPMT-REK | TQ | ------- | EF | SFFSNGAE-T | KSSNNRF--VP | 373 |
| SEQ_ID_NO_269 | TTLGIEPGDR | S- | ------- | MF | RSFQSKPE-S | REQ----IS | 453 |
| SEQ_ID_NO_264 | TTLGIK-ND- | -- | ------- | LL | KAFQSKGD-E | KKR----IA | 362 |
| SEQ_ID_NO_266 | ATLGIM-SEK | SN | --NGGS- | LF | KGFQSKNE-D | KND-----MA | 473 |
| SEQ_ID_NO_268 | SLIGIG-GDK | AG | --NGGG- | LA | RVFEQNEFAA | RTATPHSAAI | 409 |
| SEQ_ID_NO_271 | SLIGIK-GDK | AKQ-QDDDAA | RGCK- | VG | MVFEPKRE-A | TKKPAA--MM | 496 |
| SEQ_ID_NO_273 | SLIGIK-GDR | KQDAADHHGA | GGHKQKQL | HG | TVFEQKRE-A | KKQP----AMI | 411 |
| | | | AGHK- | | | | |

| | | | |
|---|---|---|---|
| SEQ_ID_NO_263 | ETYLNLQANP | AAMARSMNFR | ESI | 396 |
| SEQ_ID_NO_269 | GAARVLQANP | AALSRSQSFQ | ETT | 476 |
| SEQ_ID_NO_264 | EMSPVLQANP | AALSRSLNFH | ERA | 385 |
| SEQ_ID_NO_266 | GRTSVLQANP | AALSRSLNFH | ENN | 496 |
| SEQ_ID_NO_268 | SGLPFLQGNP | AALSRSLTFQ | EGS | 432 |
| SEQ_ID_NO_271 | TSSPLLHANP | VALTRSVAFQ | EGS | 519 |
| SEQ_ID_NO_273 | ASSPLLHTNP | VALTRSVTFQ | EGS | 434 |

| SEQ_ID | | | | | | |
|---|---|---|---|---|---|---|
| SEQ_ID_NO_132 | MMEKREL N SS | RGQRC M QNCH | | | I NKNA A GFF | I ALT L AI | 38 |
| SEQ_ID_NO_129 | | | | | EL PNSM L | LALFLAI | 15 |
| SEQ_ID_NO_125 | | | | M | RLRDSAAMVA | LVLAL | 16 |
| SEQ_ID_NO_127 | | | MT MGL | M | GL RDSS V LLA | AL ALA Y | 19 |
| SEQ_ID_NO_131 | MEF DKS | AKDCY Q SLQR | M | RVRDSSALLA | LAVALA C | 22 |
| SEQ_ID_NO_121 | | | | M | SL L AE M KF L F | LAI VFM | 33 |
| SEQ_ID_NO_123 | | | | | RF V I SA FFF | L MMFSY T GE | 28 |
| SEQ_ID_NO_120 | | | | M | RL V V SA L | L CVLV | 12 |
| SEQ_ID_NO_122 | | | | | RL V I SAA VCV | LVLFSYAGE | 30 |
| SEQ_ID_NO_117 | | | | | RL F LFS | F CFFFF M | 13 |
| SEQ_ID_NO_118 | | | | M | RL S SG FFFF | FFFFFS V | 18 |

...continued alignment with positions 74, 51, 52, 55, 58, 69, 77, 48, 80, 49, 54 and 124, 100, 101, 104, 107, 118, 126, 97, 129, 98, 103.

Figure 3

| | | | | | | |
|---|---|---|---|---|---|---|
| SEQ_ID_NO_132 | HCCKKDPTVV | DLLPGVPYNQ | QFTNCCKGGA | ASWAQDPPN | SVASFQVSVG | 174 |
| SEQ_ID_NO_129 | HCCKHTPSVV | DLLPGVPYNQ | QIANCCRGGV | VSAYGQDPAG | ALSAFQVSVG | 150 |
| SEQ_ID_NO_125 | HCCKRTPAVV | DLLPGVPYNQ | QIANCCKAGV | VAAYGQDPAA | AVSAFQVSVG | 151 |
| SEQ_ID_NO_127 | HCCKRTPAVV | DLLPGVPYNQ | QIANCCKAGV | VSAYGQDQAG | SVSAFQVSVG | 154 |
| SEQ_ID_NO_131 | HCCKKTPTVV | DLLPGVPYNQ | QIANCCKAGV | VSAYGQDPAG | SVSAFQVSVG | 157 |
| SEQ_ID_NO_121 | HCCKKTPTVV | DLLPGVPYNQ | QFSNCCKGGV | MAAWGQDPTA | SVSAFQVSVG | 168 |
| SEQ_ID_NO_123 | HCCKKTPTVV | DLLPGVPYNQ | QFSNCCKGGV | VSSWGQDPAA | SVSAFQVSVG | 176 |
| SEQ_ID_NO_120 | HCCKKLPTVV | DLLPGVPYNQ | QFSNCCKGGV | VAAWGQDPSQ | AISSFQVSIG | 147 |
| SEQ_ID_NO_122 | HCCKKTPTVV | DLLPGVPYNQ | QFSNCCKGGV | VAAWGQDPSS | AVSSFQVSIG | 179 |
| SEQ_ID_NO_117 | HCCKKTPTVV | DLLPGVPYNQ | QFSNCCKGGV | GAWGQDPSA | AVSQFQVSAG | 148 |
| SEQ_ID_NO_118 | HCCKKTPTLV | DLLPGVPYNQ | QFSNCCKGGV | VAAWGQDPSA | SVSQFQVSVG | 153 |

| | | | | | | |
|---|---|---|---|---|---|---|
| SEQ_ID_NO_132 | NSGTTNKTVK | LPKNFTLKAP | GPGYTCGPAK | IVKSSLFLST | DRRRLTQALM | 224 |
| SEQ_ID_NO_129 | LAGTTNKTVK | LPKNFTLMGP | GLGYTCGPAT | VVPSTVYWSA | DHRRKTQALM | 200 |
| SEQ_ID_NO_125 | LAGTTNKTVK | LPRNFTLQGP | GPGYTCGPAR | IIPSTVYLTP | DRRRRTQALM | 201 |
| SEQ_ID_NO_127 | LAGTTNKTVK | LPKNFTLMGP | GPGYTCGPAT | VVPSTVYWTP | DHRRRTQALM | 204 |
| SEQ_ID_NO_131 | LAGTSNKTVK | LPRNFTLMGP | GLGYTCGPAAL | VVPSTVYWTP | DHRRRTQALM | 207 |
| SEQ_ID_NO_121 | LAGTSNKTVK | LPKNFTLLGP | GPGYTCGPAK | VVPSTVFLTP | DRRRKTQALM | 218 |
| SEQ_ID_NO_123 | LAGTSNKTVK | LPKNFTLEAP | GPGYTCGLAK | VPPDTNFLTP | DRRRKTQALM | 226 |
| SEQ_ID_NO_120 | QAGTSNKTVK | LPKNFTLLGP | GPGYTCGPAK | VPSTNFLTP | DKRRKTQALM | 197 |
| SEQ_ID_NO_122 | LAGTSNKTVK | LPKNFTLLGP | GPGYTCGPAK | VVPSTVFLTA | DKRRKTQALM | 229 |
| SEQ_ID_NO_117 | LAGTSNKTVK | LPKNFTLLGP | GPGYTCGPAK | IVPSTVFLTT | DKRRKTQALM | 198 |
| SEQ_ID_NO_118 | LAGTSNKTVK | LPKNFTLLGP | GLGYTCGPAK | VPSTIFLTP | DKRRKTQALM | 203 |

| | | | | | | |
|---|---|---|---|---|---|---|
| SEQ_ID_NO_132 | TWNVTCTYSQ | FLAQKSSTCC | VSLSSFYNDT | TPCPTCACA | C | 265 |
| SEQ_ID_NO_129 | TWTVTCTYSQ | QLASRYPTCC | VSFSSFYNST | VPCARCACG | CGAHKSTGR | 250 |
| SEQ_ID_NO_125 | TWALTCTYSQ | QLASKYPSCC | VSFSSFYNST | VPCARCACG | C--------GH | 244 |
| SEQ_ID_NO_127 | TWTVTCTYSQ | QLASKYPSCC | VSFSSFYNST | VPCARKCACG | C---------- | 247 |
| SEQ_ID_NO_131 | TWTVTCTYSQ | QLASRYPSCC | VSFSSFYNET | VPCARCACG | C--------GH | 251 |
| SEQ_ID_NO_121 | TWNVTCTYSQ | FLASKNPTCC | VSFSSFYNST | TPCPTCACG | C---------- | 259 |
| SEQ_ID_NO_123 | TWNVTCTYSQ | LRARKNPSCC | VSFSSFYNET | TPCPSCACG | C---------- | 267 |
| SEQ_ID_NO_120 | TWNVTCTYSQ | FLARKNPSCC | VSLSSFYNST | TPCPSCACG | C---------- | 238 |
| SEQ_ID_NO_122 | TWNVTCTYSQ | FLARKNPGCC | VSLSSFYNET | TPCPSCACG | C---------- | 270 |
| SEQ_ID_NO_117 | TWNVTCTYSQ | FLARKHPSCC | VSFSSFYNDT | TPCPSCACG | C---------- | 239 |
| SEQ_ID_NO_118 | TWNVTCTYSQ | FLARKHPSCC | VSFSSFYNDT | TPCPSCACG | C---------- | 244 |

```
SEQ_ID_NO_132   FPRRLYFNGD  QCVMPSPDAY  PWLPSTAHPA  PAPPSLFAFI  PLALALAIV   465
SEQ_ID_NO_129   FPRKIYFNGD  ECKMPPPDSY  PYLPNS----  -APPRSSIT   AAASTCLVLL  443
SEQ_ID_NO_125   FPRKIYFNGD  ECKMPPPDSY  PYLPNS----  -APLAAPVIL  ATAASAFLLV  435
SEQ_ID_NO_127   FPRKIYFNGD  ECKMPPPDSY  PYLPNA----  -APVAASQLV  VSAAASAFLL  440
SEQ_ID_NO_131   FPRKIYFNGD  ECKMPPPDSY  PYLPNA----  -APVVASQLV  LSAAASAFLL  444
SEQ_ID_NO_121   FPRKVYFNGD  ECKMPPPDSY  PYLPNS----  -AYANPTSI   -LSMAASLLL  447
SEQ_ID_NO_123   FPRKVYFNGD  ECMLPPPDTY  PFLPNS----  -AHQNLLAF   -STFISSVIF  454
SEQ_ID_NO_120   FPRKVYFNGD  ECMLPPETY   PFLPNS----  -APASLLNF   -PAFMLLLF   425
SEQ_ID_NO_122   FPRKVYFNGD  ECMLPPPDTY  PFLPNS----  -APVNLLNF   ---TVFILTML 457
SEQ_ID_NO_117   FPRKVYFNGD  ECMLPPPDSY  PFLPNS----  -AQGNFASF   ---SLTILLL  425
SEQ_ID_NO_118   FPRKVYFNGD  ECMLPPPDTY  PFLPNS----  -AHGNLSSLW  TLPLALLLL   434

SEQ_ID_NO_132   PSLFLP      471
SEQ_ID_NO_129   LLLLAA      449
SEQ_ID_NO_125   ALLLVA      441
SEQ_ID_NO_127   ALLLVA      446
SEQ_ID_NO_131   LLLLVA      450
SEQ_ID_NO_121   ILLSMG      453
SEQ_ID_NO_123   LVLTVW      460
SEQ_ID_NO_120   FLLAVW      431
SEQ_ID_NO_122   VMLALW      463
SEQ_ID_NO_117   LFISIW      431
SEQ_ID_NO_118   LLISIW      440
```

| | | | | | | |
|---|---|---|---|---|---|---|
| SEQ_ID_NO_10 | MAPRGK- | ------ | ------ | ------LSTVA | DGE--- | GKEMRFRGVR KRPWGRYAAE | 34 |
| SEQ_ID_NO_2 | MAPRAA- | -EK | APVSPPTGLG | LGLGGGVGV- | AGGAHYRGVR KRPWGRYAAE | 48 |
| SEQ_ID_NO_1 | MAPRAAT | VEK | VAVAPPTGLG | LGVGGGVGL- | AGGPHYRGVR KRPWGRYAAE | 48 |
| SEQ_ID_NO_4 | MAPRAA- | -DK | SPVPPATGLG | LGVGGAVGGL | GMGPHYRGVR KRPWGRYAAE | 48 |
| SEQ_ID_NO_6 | MAPRVA- | -DK | SPLPPATGLG | LGVGGVVGGV | GMGPHYRGVR KRPWGRFAAE | 48 |
| SEQ_ID_NO_8 | MAPRVA- | -DK | SPLPPATGLG | LGVGGGVGGV | GMGPHYRGVR KRPWGRYAAE | 48 |
| SEQ_ID_NO_14 | MESKNR- | -K- | WLQERSNSTG | NNLNQNSN-- | TAETRYRGVR KRPWGRYAAE | 45 |
| SEQ_ID_NO_15 | MAVKNK- | --- | ---V-SNGNLK | GGNVKTDG-- | VKEVHYRGVR KRPWGRYAAE | 41 |
| SEQ_ID_NO_13 | MAPRDK- | --- | ------PTGVT | AGATG---- | NKELRYRGVR KRPWGRYAAE | 36 |
| SEQ_ID_NO_11 | MAPRDH- | --- | ----KTSNAKANG | NGNSG---- | VKEVHFRGVR KRPWGRYAAE | 40 |
| SEQ_ID_NO_12 | MAPREK- | --- | ------TPAVKVN | AG------ | VKEVHFRGVR KRPWGRYAAE | 35 |

| | | | | | | |
|---|---|---|---|---|---|---|
| SEQ_ID_NO_10 | IRDPSKKTRV | WLGTFDTAEE | AARAYDNAAR | DFRGAKAKTN | FAFS------ | 78 |
| SEQ_ID_NO_2 | IRDPAKKSRV | WLGTYDTAEE | AARAYDTAAR | EFRGAKAKTN | FPFP------ | 93 |
| SEQ_ID_NO_1 | IRDPAKKSRV | WLGTYDTAEE | AARAYDAAAR | EFRGAKAKTN | FPFA------ | 92 |
| SEQ_ID_NO_4 | IRDPAKKSRV | WLGTYDTAEE | AARAYDAAAR | DFRGAKAKTN | FPFP------ | 92 |
| SEQ_ID_NO_6 | IRDPAKKSRV | WLGTYDTAEE | AAKAYDAAAR | EFRGAKAKTN | FPFP------ | 92 |
| SEQ_ID_NO_8 | IRDPGKKTRV | WLGTFDTAEE | AAKAYDSAAR | EFRGSKAKTN | FPFP------ | 92 |
| SEQ_ID_NO_14 | IRDPGKKSRV | WLGTFDTAEE | AAKAYDTAAR | EFRGAKAKTN | FPTVTELNNA | 95 |
| SEQ_ID_NO_15 | IRDPGKKSRV | WLGTFDTAEE | AARAYDAAAR | EFRGPKAKTN | FPSP------ | 85 |
| SEQ_ID_NO_13 | IRDPGKKSRV | WLGTFDTAEE | AARAYDAAAR | EFRGPKAKTN | FPSP------ | 80 |
| SEQ_ID_NO_11 | IRDPGKKSRV | WLGTFDTAEE | AARAYDAAAR | EFRGPKAKTN | FPLP------ | 84 |
| SEQ_ID_NO_12 | IRDPGKKSRV | WLGTFDTAED | AARAYDAAAR | EFRGPKAKTN | FPFPDSDDIN | 85 |

| | | | | | | |
|---|---|---|---|---|---|---|
| SEQ_ID_NO_10 | DACSSPSAVP | AATGSPSSQS | STVESSGRE- | -VAAAAVPPL | AVPLPPSLDL | 126 |
| SEQ_ID_NO_2 | SSSSSPVAGA | GGGGSP-SSD | STLDSSGGG- | SGGCAQAPMQ | AIPLPPALDL | 141 |
| SEQ_ID_NO_1 | ---SQSMV | GCGGSP-SSN | STVDTGGG-- | ---VQTPMR | AMPLPPTLDL | 131 |
| SEQ_ID_NO_4 | SQCPVAAG | AGAGSP-SSN | CTVESRGGG- | SGYGVQAPMQ | AMPLPPALDL | 138 |
| SEQ_ID_NO_6 | SQCAVAA | GGAGSP-CSN | STVDSSGGA- | SGCAVQAPMQ | AMPLPPALDL | 137 |
| SEQ_ID_NO_8 | SQCSVAS | VAAGSA-SSN | STVDSSGGG- | SGCGIQAPMQ | AMPLPPALDL | 137 |
| SEQ_ID_NO_14 | AAAVAAGAV | TVARSP-SQS | STVESSSPT- | ---PPR | AASPPPPLDL | 136 |
| SEQ_ID_NO_15 | ------ | TENQSP-SHS | STVESSSGE- | NGVHAPPH | A-----PLEL | 116 |
| SEQ_ID_NO_13 | -XDLAAAXT | TANRSP-SQS | STVESSSRE- | ------ALSPG | AIAGPPALDL | 122 |
| SEQ_ID_NO_11 | ---LEN | VKNSP-SQS | STVESSSRD- | -------RD | VAADSSPLDL | 117 |
| SEQ_ID_NO_12 | SNNNIVVVK | NNNRSP-SQS | STVESSSRDR | DSYSAAAAT | AVADSSPLDL | 134 |

| | | | | | | |
|---|---|---|---|---|---|---|
| SEQ_ID_NO_660 | GI GAA FYADL | GI DETEI FVS | DGAKCDI TRL | QLVFG P NVTM | A A QDPSYPAY | 191 |
| SEQ_ID_NO_653 | AI AATYYADL | GI EETDI FVS | DGAKCDI SRL | QVLFGSNVKI | AVQDPSYPAY | 193 |
| SEQ_ID_NO_655 | AI AATYY V DL | GI EDSDI FVS | DGAKCDI SRL | QVLFGSNVTI | AVQDPSYPAY | 198 |
| SEQ_ID_NO_657 | AI AATYYADL | GI EDSDI FVS | DGAKCDI SRL | QVLFGSNVTI | AVQDPSYPAY | 191 |
| SEQ_ID_NO_659 | AI ASTFYGDL | GI EESDI FVS | DGAKCDI SRL | QVMFGSNVTI | AVQDPSYPAY | 191 |
| SEQ_ID_NO_652 | AI AK T FYGGL | S I G DDVFVS | DGAK S DI SRL | QVMFGSNVTI | AVQDPSYPAY | 188 |
| SEQ_ID_NO_651 | AI ASTFYSGL | GI EEDDI FVS | DGAKCDI SRL | QMVFGANVTM | AVQDPSYPAY | 190 |
| SEQ_ID_NO_649 | AI ASTFYSDL | GI EEDDI FVS | DGAKCDI SRL | QI VFGSNVKM | AVQDPSYPAY | 190 |
| SEQ_ID_NO_645 | ALASTFY R NL | GI EDDDI FVS | DGAKCDI SRL | QVVFGSNVTM | AVQDPSYPAY | 187 |
| SEQ_ID_NO_647 | ALASTFY R NL | GI EDDDI FVS | DGAKCDI SRL | QVVFGSNVTM | AVQDPSYPAY | 191 |

| | | | | | | |
|---|---|---|---|---|---|---|
| SEQ_ID_NO_660 | VDTSVMMGQT | GLFQ S D S QQY | S KI QYMKCTP | EN D FFPDLSS | T PRTDI I FFC | 241 |
| SEQ_ID_NO_653 | VDSSVI MGQT | GLYQEDVQKY | GNI EYMKCSP | ENGFFPDLSS | VPRTDI I FFC | 243 |
| SEQ_ID_NO_655 | VDSSVI M S QT | GLYQQDVQKY | GNI EYMRCNP | ENGFFPDLST | VPRTDI I FFC | 248 |
| SEQ_ID_NO_657 | VDSSVI MGQT | DLYQQDVQKY | GNI QYMRCSP | ENGFFPDLST | I PRTDI I FFC | 241 |
| SEQ_ID_NO_659 | VDSSVI MGQT | DLYQQDVQKY | GNI EYMRC GP | ENGFFPDLST | VPRTDI I FFC | 241 |
| SEQ_ID_NO_652 | VD L SVI LGQT | GQFQKDVEKY | GNI EYMKCNP | ENGFFPDLST | VSRTDI I FFC | 238 |
| SEQ_ID_NO_651 | VDSSVI MGQT | GQF NT DVQKY | GNI EYMRCTP | ENGFFPDLST | V G RTDI I FFC | 240 |
| SEQ_ID_NO_649 | VDSSVI MGQT | GQFQKDVEKY | GKI EYMRCTP | ENGFFPDLSK | VSRTDI I FFC | 240 |
| SEQ_ID_NO_645 | VDSSVI MGQT | GLFQKNVEKF | A NI EYMRCNP | ENGFFPDLSS | I SR P D I I FFC | 237 |
| SEQ_ID_NO_647 | VDSSVI MGQT | GQFQKDVEKY | GNI EYMRCTP | ENGFFPDLSK | V A RTDI I FFC | 241 |

| | | | | | | |
|---|---|---|---|---|---|---|
| SEQ_ID_NO_660 | SPNNPTGASA | SRKQLE F LV A | FAKKNGSI I V | YDSAYAI Y T S | DDSPKSI YEI | 291 |
| SEQ_ID_NO_653 | SPNNPTGAAA | SRDQLTKLVK | FAKDNGSI I V | YDSAYAMYI S | DDSPKSI FEI | 293 |
| SEQ_ID_NO_655 | SPNNPTGAAA | SRDQLTRLVK | FAKDNGSI I V | YDSAYAMYI S | DDSPKSI FEI | 298 |
| SEQ_ID_NO_657 | SPNNPTGAAA | SRDQLTKLVK | FAKDNGSI I V | YDSAYAMYI S | DDSPKSI FEI | 291 |
| SEQ_ID_NO_659 | SPNNPTGAAA | SRDQLTKLVK | FAKDNGSI I V | YDSAYAMYI S | DDSPRSI FEI | 291 |
| SEQ_ID_NO_652 | SP V NPTG N AA | TREQLTRLVQ | FAKKNGSI L V | YD S G YAMYI S | DDNPRSI FEI | 288 |
| SEQ_ID_NO_651 | SPNNPTGAAA | TREQLTQLVE | FAKDNGSI I V | YDSAYAMYI S | DDNPRSI FEI | 290 |
| SEQ_ID_NO_649 | SPNNPTGSAA | TREQLTQLVQ | FAKDNGSI I V | YDSAYAMYI S | DDNPRSI FEI | 290 |
| SEQ_ID_NO_645 | SPNNPTGA V A | TREQLTQLVQ | FAKDNGSI VI | HDSAYAMYI S | G DNPRSI FEI | 287 |
| SEQ_ID_NO_647 | SPNNPTGAAA | TREQLTRLVK | FAKDNGSI I V | YDSAYAMYMS | DDNPRSI FEI | 291 |

| | | | | |
|---|---|---|---|---|
| SEQ_ID_NO_660 | SAFGHRENIL | EAS RRLKEMF | GSKK | 465 |
| SEQ_ID_NO_653 | SAFGHRENII | EAARRLKQLY | K--- | 464 |
| SEQ_ID_NO_655 | SAFGHRENII | EAARRLKQLY | K--- | 469 |
| SEQ_ID_NO_657 | SAFGHRDNII | EAARRLKQLY | K--- | 462 |
| SEQ_ID_NO_659 | SAFGHRENII | EAARR X KQLY | K--- | 462 |
| SEQ_ID_NO_652 | C AFS HRG NVL | EACKRFKRLY | K--- | 459 |
| SEQ_ID_NO_651 | SAFGHRENIL | EACRRFKQLY | K--- | 461 |
| SEQ_ID_NO_649 | SAFGHRENVL | EACRRFKQLY | N--- | 461 |
| SEQ_ID_NO_645 | SAFGHRENVL | EACRRFKQLY | K--- | 458 |
| SEQ_ID_NO_647 | SAFGHRENVL | EACRRFKQLY | N--- | 462 |

Figure 5 Continued

```
SEQ_ID_NO_257  MAF- GVRLCL CLLLVFAVTS S- ARNTI SES  DNEMALAI KG  RSLKITLNDY    48
SEQ_ID_NO_253  MTFL VVRLLV CLLLTLTI TS SL ARNPVSVS  GGFENSGFQR  SLI MVNVEDY    49
SEQ_ID_NO_255  MSFVVLRLAV FLLLTLTVTY SI--SPSSVS     VPVVKI GI ER RSLI VNVKDY    47

SEQ_ID_NO_257  GDPI ANRGHD PSQRNKNWGG SGGGRKG                                  75
SEQ_ID_NO_253  GDPSANPKHD PGVPPSATGQ RVVGR-G                                   75
SEQ_ID_NO_255  DGPSANPKHN PGTPPVTTSQ RSPGR-G                                   73
```

| | | | | | |
|---|---|---|---|---|---|
| SEQ_ID_NO_630 | TFGSPDEPVT | VISFGPKFLS | LLYDSSPIE | DYELAKMLTR | PLPNYVTDLG | 186 |
| SEQ_ID_NO_595 | TYGSFDNSGL | SVFFSTDFMK | HRLYQLSPVE | DLELGLLLKR | PSSLFINELS | 190 |
| SEQ_ID_NO_615 | LVGDEDKGPV | SLLFGPKFLS | -KLYFTRSPPE | DLTLARTLMR | PSSEFLEDLG | 196 |
| SEQ_ID_NO_623 | TYGNPENPGM | SMILGPQFMA | LKMFQNCSVE | DLELAKMLTR | PGSLFFQDLA | 193 |
| SEQ_ID_NO_642 | AYG--DPPIT | SLVCGPEFIS | STLYHLSPIE | DHALGKILVR | PGSLFIEDLL | 185 |
| SEQ_ID_NO_611 | AYG--EPPIT | ALLCGPEFIS | TSLYHLSPVE | DHTLGKLLVR | PGALFVEDLL | 185 |
| SEQ_ID_NO_605 | QCDASNPSHI | SMLFGREFLT | IKIYQLCPPE | DLELAKMLVR | PGSMFIDNLS | 194 |
| SEQ_ID_NO_620 | PYGSPEEPLT | SMFFGPKFLA | HKLYQLSPPE | DLALASSLVR | PSSLFMEDLS | 187 |
| SEQ_ID_NO_632 | PYGTPEEPLT | SMTFGPKFLA | DKLYRLSPPE | DVALGLSLVR | TSSLFLEDLS | 191 |
| SEQ_ID_NO_622 | PYSSSQSHLT | TMSFGPKFLS | SKLYQLSPPE | DLEQAKTMVR | PGSLFLYDLS | 190 |
| SEQ_ID_NO_616 | PYGSSEKPQN | SMFFGPEFIS | TKLYQLSPIE | DLELVLALAR | PASLFLEDLA | 191 |

| | | | | | |
|---|---|---|---|---|---|
| SEQ_ID_NO_630 | K-AEKLSDGK | YGSVRRVYYI | CKEDKAIPDE | LVGQMIEMN- | GLKEVIELQG | 234 |
| SEQ_ID_NO_595 | K-MENFSEKG | YGSVPRAYIV | CKEDNI-SED | HQRWMIHNY- | PANLVLEMEE | 238 |
| SEQ_ID_NO_615 | S-MPPFSESG | YGSVEKIYYV | CAQDEILTEG | FQRWMIENN- | PVKEVRELED | 244 |
| SEQ_ID_NO_623 | K-AKKFSTER | YGSVKRAYIF | CNEDKSFPVE | FQKWEVESV- | GADKVKEIKE | 241 |
| SEQ_ID_NO_642 | K-AEKFTEEG | FGSVPRVYVI | AAEDKTIPPE | FQRWMIENN- | PVKEVKEIKG | 233 |
| SEQ_ID_NO_611 | KGAVKFTDEG | FGSVPRVYVV | ATEDKTIPPE | FQRWMIENN- | PVAEVKEIEG | 234 |
| SEQ_ID_NO_605 | K-ESKFSDEG | YGSVKRVYLV | CEEDGLPKQ | FQHMMIQNY- | PVNEVMEIKG | 242 |
| SEQ_ID_NO_620 | K-AKYFTDER | YGSVKRVYYI | CTEDKGIPEE | FQRWQIDNI- | GVTEAIEIKG | 235 |
| SEQ_ID_NO_632 | K-ANSFSTIG | YGSVKRVYYI | CDEDLAIPEE | FQQWQIDNI- | GVTEAKEIKG | 239 |
| SEQ_ID_NO_622 | EL-LKKFSNEG | YGSVTSMFIR | CDKDEAIRKE | FQQWMIENS- | AVEEVMEIEG | 238 |
| SEQ_ID_NO_616 | | | | FQQWMIENSG | GVKEVMNLKD | 240 |

| | | | |
|---|---|---|---|
| SEQ_ID_NO_630 | ADHMPMLSNP | QQLCDCLVQI | AVENP | 259 |
| SEQ_ID_NO_595 | TDHMPMFCKP | QMLSDHLLA | ADNFS | 263 |
| SEQ_ID_NO_615 | ADHMPMFSTP | KQLFQCLSDV | ADACA | 269 |
| SEQ_ID_NO_623 | ADHMGMLSQP | REVCKCLLDI | SDS-- | 264 |
| SEQ_ID_NO_642 | ADHMPMFSKP | DELSQCLLDI | AKKHA | 258 |
| SEQ_ID_NO_611 | ADHLPQFSKP | DELTQMLVDI | AKNHG | 259 |
| SEQ_ID_NO_605 | GDHMAMLSDP | QKLCDCLSQI | SLKYA | 267 |
| SEQ_ID_NO_620 | ADHMAMLCEP | QKLCASLLEI | AHKYN | 260 |
| SEQ_ID_NO_632 | ADHMAMLCMP | KKLCDTLVEI | ADKYN | 264 |
| SEQ_ID_NO_622 | ADHMVMFSKP | QELFHCLSEI | ANKHA | 263 |
| SEQ_ID_NO_616 | ADHMAMFSKP | EELCACLLEV | AHKYG | 265 |

| | | | | | |
|---|---|---|---|---|---|
| SEQ_ID_NO_88 | ---------- | ---------MDG | ------S | NPPPPQPKC-A | MME----AMGE | 24 |
| SEQ_ID_NO_86 | MAASTLQYHF | AFFLFFLMIA | LITR---- | AMRDALEWPM | 46 |
| SEQ_ID_NO_77 | -MAASSLNLL | LILSLLTFIS | SFSPR- | AQVDETSL-K | LLPDGFDWPI | 43 |
| SEQ_ID_NO_79 | MAAAPPLTLL | IALSLLFIS-Q | LQRS---- | SLSDNPSL-T | LLGDGFDWPI | 43 |
| SEQ_ID_NO_87 | MESPILFFL | IFLTITNN-E | LQRS---- | SLPENPSM-L | LVSEDFELPM | 44 |
| SEQ_ID_NO_82 | MACSSLPKLL | VLCAFFVYIS | A VI----- | AQVDKFGLEQ | LITDSLEWPS | 44 |
| SEQ_ID_NO_81 | MASSVLSKL | LLP---LFLT | NVVV---V | AQVDESSL-K | LVRDAFEWPL | 46 |
| SEQ_ID_NO_84 | MASLTLALL | LFCI--LAFTS | HIAVSSKTE | AQVEDTRL-K | LMSDALEWPT | 42 |
| | | | | | | |
| SEQ_ID_NO_88 | CGA------ | ----- | ----NV | DEENENEVGH | GR---LRRIR | 57 |
| SEQ_ID_NO_86 | SMY-YDESSG | LNDGLVGFDD | GVVDDEESSR | LFWRRTH | 94 |
| SEQ_ID_NO_77 | SHS--DEFD | IDGEESFEV | TEEDDGVTDR | RS-LFWRRTK | 89 |
| SEQ_ID_NO_79 | SHG--DALD | LDGGES--FE | DAEEEDVADR | RS-LYWKRRR | 87 |
| SEQ_ID_NO_87 | AMS-SLYE | E--------TE | DDEMQDGNG | RS-LLWHKEK | 83 |
| SEQ_ID_NO_82 | TMS------ | ---FFGD--ED | GEDPDGVI-DR | RS-MFWHRMR | 85 |
| SEQ_ID_NO_81 | SMSFQGDLHD | NEEGDE-EV | DDEVENGYSG | RSLWWKRMR | 94 |
| SEQ_ID_NO_84 | TMS---LYD | ---ED---DA | QEDVENAYSR | RS-LFWRRMK | 81 |
| | | | | | | |
| SEQ_ID_NO_88 | NRIPCPPRSG | RSYYTRNCYR | ATEPVRPYHR | SCTAITRCLR | DTS 100 |
| SEQ_ID_NO_86 | NRIPCPFARSG | RSYYSHNCFA | SRAPVNPYSR | GCSRIARCRR | ---- 134 |
| SEQ_ID_NO_77 | NRVPCPPRSG | RSYYTHNCFR | ARGPVHPYSL | GCSSITPGDR | ---- 129 |
| SEQ_ID_NO_79 | NRVPCPPRSG | RSYYTHNCFR | ARGQVHPYSR | GCSSITRCRR | ---- 127 |
| SEQ_ID_NO_87 | NRIPCPPRSG | RSYYTHHCYH | ATGPAHPYTR | GCSAITRCRR | ---- 123 |
| SEQ_ID_NO_82 | NRIPCPPRSG | RSYYTHNCFQ | ARGPVRPYTR | GCSTITRCRR | ---- 125 |
| SEQ_ID_NO_81 | NRIPCPPRSG | RSYYTHNCFK | AHGPVHPYTR | GCSRITRCRR | ---- 134 |
| SEQ_ID_NO_84 | NRIPCPPRSG | RSYYTHNCYR | ARGPVHPYSR | GCSAITRCRR | ---- 121 |

| SEQ_ID | | | | | | |
|---|---|---|---|---|---|---|
| SEQ_ID_NO_210 | TFGQYLKNHR | PPLALPRCSG | AHVVEFLHYL | DQFGKTKVHV | PACPFFGHPH | 103 |
| SEQ_ID_NO_209 | TFVQYLKSQN | PPLMMSQFDY | THVLSFLRYL | DQFGKTKVHH | QACVFFGQPD | 97 |
| SEQ_ID_NO_230 | TFGQYLKNQR | PPVPLSQCNY | NHVLEFLRYL | DQFGKTKVHL | HGCPFFGQPE | 111 |
| SEQ_ID_NO_214 | TFGQYLKNQR | PPVSLSQCSC | NHVLDFLRYL | DQFGKTKVHL | HGCVFFGQPN | 91 |
| SEQ_ID_NO_239 | TFGQYLKNQR | PPVSLAQCSC | NHVLEFLRYL | DQFGKTKVHL | HGCVFFGQPD | 89 |
| SEQ_ID_NO_212 | TFGQYLKNQR | PPVPLSQCNC | NHVLDFLRYL | DQFGKTKVHL | QGCMFYGQPE | 89 |
| SEQ_ID_NO_226 | TFGQYLRNQR | PPVALSQCSS | NHVLEFLRYL | DQFGKTKVHS | QGCLFFGQTE | 107 |
| SEQ_ID_NO_220 | TFLQYLKNHK | PPLALSRCSG | AHVIEFLKYL | DQFGKTKVHV | ATCPYFGHQQ | 92 |
| SEQ_ID_NO_236 | TFLQYLRNHK | PPLTLARCSG | AHVIEFLKYL | DQFGKTKVHA | DGCAYFGQPN | 131 |
| SEQ_ID_NO_238 | TFLQYLRNHR | PPLTLARCSG | AHVIEFLRYL | DQFGKTKVHA | EGCAYFGQPN | 145 |
| SEQ_ID_NO_232 | TFLQYLRNHR | PPLTLARCSG | AHVIEFLRYL | DQFGKTKVHA | SGCAFYGQPS | 91 |
| SEQ_ID_NO_242 | TFLQYLRNHR | PPLTLARCSG | AHVIEFLRYL | DQFGKTKVHA | SGCAFYGQPS | 91 |
| SEQ_ID_NO_241 | TFLQYLRNHR | PPLTLARCSG | AHVIEFLRYL | DQFGKTKVHA | AGCAYYGQPA | 94 |
| SEQ_ID_NO_234 | TFLQYLRNHR | PPLTLARCSG | AHVIEFLRYL | DQFGKTKVHA | AGCAYYGQPA | 93 |

| SEQ_ID | | | | | | |
|---|---|---|---|---|---|---|
| SEQ_ID_NO_210 | PPAPCACPLR | QAWGSLDALI | GRLRAAYEEN | -GGKPESNPF | GARAVRLYLR | 152 |
| SEQ_ID_NO_209 | PPGPCTCPLK | QAWGSLDALI | GRLRAAYEEH | GGGSPDTNPF | ANGSIRVHLR | 147 |
| SEQ_ID_NO_230 | PPGPCTCPLR | QAWGSLDALI | GRLRAAYEEN | -GGLPENNPF | ASGAIRVYLR | 160 |
| SEQ_ID_NO_214 | PPAPCTCPLR | QAWGSLDALI | GRLRAAYEEH | -GGSAETNPF | GNGAIRVYLR | 140 |
| SEQ_ID_NO_239 | PPAPCTCPLR | QAWGSLDALI | GRLRAAYEEH | -GGSPETNPF | GNGAIRVYLR | 138 |
| SEQ_ID_NO_212 | PPGPCTCPLR | QAWGSLDALI | GRLRAAYEEN | -GGSPETNPF | ASGAIRVYLR | 138 |
| SEQ_ID_NO_226 | PPGPCTCPLR | QAWGSLDALI | GRLRAAYEEN | -GGLPETNPF | ASGTRVYLR | 156 |
| SEQ_ID_NO_220 | PPSPCACPLK | QAWGSLDALI | GRLRAAYEEH | -GGRPDSNPF | AARAVRIYLR | 141 |
| SEQ_ID_NO_236 | PPAPCACPLR | QAWGSLDALI | GRLRAAYEEN | -GGRPESNPF | AARAVRIYLR | 180 |
| SEQ_ID_NO_238 | PPAPCTCPLR | QAWGSLDALI | GRLRAAYEES | -GGRPESNPF | AAKAVRIYLR | 194 |
| SEQ_ID_NO_232 | PPGPCPCPLR | QAWGSLDALI | GRLRAAYEES | -GGTPESNPF | AARAVRIYLR | 140 |
| SEQ_ID_NO_242 | PPGPCPCPLR | QAWGSLDALI | GRLRAAYEES | -GGTPESNPF | AARAVRIYLR | 140 |
| SEQ_ID_NO_241 | PPGPCPCPLR | QAWGSLDALI | GRLRAAYEES | -GGTPESNPF | AARAVRIYLR | 143 |
| SEQ_ID_NO_234 | PPGPCPCPLR | QAWGSLDALI | GRLRAAYEES | -GGTPESNPF | AARAVRIYLR | 142 |

| | | |
|---|---|---|
| SEQ_ID_NO_210 | LCPTL`PL`QMSL | 226 |
| SEQ_ID_NO_209 | ANSSTPNQSF`T` | 191 |
| SEQ_ID_NO_230 | PTTT`FQFQS`S | 205 |
| SEQ_ID_NO_214 | --EAKPP`MQS`A | 177 |
| SEQ_ID_NO_239 | --EAKSSKQS X | 175 |
| SEQ_ID_NO_212 | GDESSST`HF``S` | 175 |
| SEQ_ID_NO_226 | GDTSSSNL`PM`Q | 194 |
| SEQ_ID_NO_220 | V`AEA`V`PPL`- | 198 |
| SEQ_ID_NO_236 | GKEKE`AA`E`GS`A | 284 |
| SEQ_ID_NO_238 | `S`KEKE`GS``APS``S` | 305 |
| SEQ_ID_NO_232 | GSGTAPSAS- | 212 |
| SEQ_ID_NO_242 | GSGTAPSAS- | 212 |
| SEQ_ID_NO_241 | GSSAAPSNT- | 208 |
| SEQ_ID_NO_234 | GSSAAPSTT- | 215 |

Figure 10 Continued

| SEQ_ID_NO | Sequence | # |
|---|---|---|
| SEQ_ID_NO_437 | -MGVEGEGSV ETALLEEGSI SSVQTGKASE DEYTGDGSVD FMGRPSVKEN | 49 |
| SEQ_ID_NO_440 | ----------M GSVEDDSSRL EEALIQDEES KLYTGDGSVD FKGRPVLKKN | 41 |
| SEQ_ID_NO_438 | ---------- MGSLEERLLV EDEPVKNDGI GLYTGDGSVD IDGKPVLKEN | 40 |
| SEQ_ID_NO_439 | ---------- MKYLFSK--- NGGLLEDENS GLYTRDGSVD IKGNPVLKSE | 37 |
| SEQ_ID_NO_435 | ---------- ---------- -----MGEVAA ELYTQDGTID KGNPALKKD | 26 |
| SEQ_ID_NO_436 | ---------- ---------- -MNAVGGAPD SEYPQDGTVD LRGNPVLKAN | 29 |
| SEQ_ID_NO_442 | ---MKMRA-- IVVEGGEMSA PTPTPKQDKC CEYTLDGSVD IKGRPAVKGK | 45 |
| SEQ_ID_NO_447 | MSANEGDLKM RVIAMGGEAA SERRAAFEKL CEYTLDGSVD LKGRPAVKGK | 50 |
| SEQ_ID_NO_444 | ---------- MEPGICNSV NSVNVEATEK KVTGNGSYT EQSDTSYKKI | 39 |
| SEQ_ID_NO_431 | ---------- ---------M APTAVDSKRI SDITEDGSMD RRGNPAVKAK | 31 |
| SEQ_ID_NO_446 | ---------- ---------M DATTVDSKWI SPATEDGSMD RRGNPAVKTT | 31 |
| SEQ_ID_NO_433 | ---------- ---------M DPTTVESKWV SPTTEDGSMD RRGNPAAKAA | 31 |
| SEQ_ID_NO_426 | ---------- ---------- MDQKVRHT EVCTQDGSVD RHGNPAIRAN | 28 |
| SEQ_ID_NO_448 | ---------- ---------- MDQKVRHT EVCTQDGSVD RHGNPAIRAK | 28 |
| SEQ_ID_NO_430 | ---------- ----MVNKEL MVNKEL EVCTLDGSID RHGDPAIRGR | 26 |
| SEQ_ID_NO_428 | ------MA-- CLNCKEEGS VQGKLVKKEQ EVCTLDGSID SHGHPAVRER | 42 |
| SEQ_ID_NO_429 | ---------- ---------- MYLNPL SECTFDGSVD RHGHPAVRAR | 26 |

| SEQ_ID_NO | Sequence | # |
|---|---|---|
| SEQ_ID_NO_437 | TGNWRACPFI LGNECCERLA YYGINTNLVT -YLTKRLHQG NAAAAKSVTT | 98 |
| SEQ_ID_NO_440 | TGNWKACPFI LGNECCERLA YYGIATNLVT PILAKLHEG NVSAARNVTT | 91 |
| SEQ_ID_NO_438 | TGKWRACPFI GTECCERLA YYGIATNLVT YLTSKLHEG NASAARNVTT | 89 |
| SEQ_ID_NO_439 | TGNWRACPFI LGNECCERLA YYGIAANLVT YLTKKLHEG NVSAARNVTT | 86 |
| SEQ_ID_NO_435 | TGNWRACPYI LANECCERLA YYGMSTNLVN FMKDRMGMA NAAAANNVTN | 75 |
| SEQ_ID_NO_436 | TGGWKACPYI LGNECCERLA YYGIATNLVT YLSHELHQN PSTAANNVTN | 78 |
| SEQ_ID_NO_442 | SGGWLAGAI LVNQGLATLA FFGVNVNLVL FLTRVLGQS NEDAANNVSK | 94 |
| SEQ_ID_NO_447 | SGGWLAGGLI LVNQGLATMA FFGVNVNLVL FLTRLVQQS NGDAANNVSK | 99 |
| SEQ_ID_NO_444 | KGGWKTAIL LANQALATMA FFGVGVNLVL FLTRVLRQD SAEAANNVSK | 88 |
| SEQ_ID_NO_431 | TGNWRSS LVNYGLVTCA FFGVGVNLVT FLTRVLHQD NAEAANNVSK | 80 |
| SEQ_ID_NO_446 | TGRWRSAI LL ANYGLATCA FFGVGVNLVV FLTRVLHQD NAEAANSI SK | 80 |
| SEQ_ID_NO_433 | SGRWRSAI LL ANYGLVTCA FFGVGVNLVL FLTRVLHQD NAEAANSI SK | 80 |
| SEQ_ID_NO_426 | TGKWLTAIL LVNQGLATLA FFGVGVNLVL FLTRVLHQD NAEAANNI SK | 80 |
| SEQ_ID_NO_448 | TGKWLTAIL LVNQGLATLA FFGVGVNLVL FLTRVMGQD NAEAANNVSK | 77 |
| SEQ_ID_NO_430 | TGTWFAGIL LVNQGLATLA FFGVGVNLVL FLTRVMGQD NADAANNVSK | 77 |
| SEQ_ID_NO_428 | TGTWFAGIL LVNQGLATLA FFGVGVNLVL FLTRVLGQD NAEAANNVSK | 91 |
| SEQ_ID_NO_429 | TGNWTAI LI LVNQGLATLA FFGVGVNLVL FLTRVLGQD NATAANNVSK | 75 |

Figure 11

| SEQ_ID_NO | | | | | | |
|---|---|---|---|---|---|---|
| SEQ_ID_NO_437 | W A G T C Y L T P L | F G A V L A D A Y W | G R Y W T I A A F S | T I Y F I G M A T L | T L S A S V S S L K | 148 |
| SEQ_ID_NO_440 | W Q G T C Y L A P L | I G A V L A D S Y W | G R Y W T I A I F S | M I Y F I G M G T L | T L S A S I P A L K | 141 |
| SEQ_ID_NO_438 | W S G T C Y L A P L | V G A V L A D S Y W | G R Y W T I A V F S | I I Y F I G M G T L | T L S A S V A A F K | 139 |
| SEQ_ID_NO_439 | W Q G T C Y I T P L | V G A V L A D A Y W | G R Y W T I A T F S | T I Y F I G M C T L | T L S A S V P A F K | 136 |
| SEQ_ID_NO_435 | W G G T C Y I T P L | I G A F L A D A Y L | G R F W T I A S F M | I I Y I F G L G L L | T M A T S V H G L V | 125 |
| SEQ_ID_NO_436 | W S G T C Y I T T L | I G A F L A D A Y L | G R F W T I A S V F S | I I Y F L G M V L L | T L S A A L P S L K | 128 |
| SEQ_ID_NO_442 | W T G T V Y M F S L | L G A F L S D S Y W | G R Y K T C A I F Q | A I F V L G L A L L | S V S S H L Y L I R | 144 |
| SEQ_ID_NO_447 | W T G T V Y M F S L | L G A F L S D S Y W | G R Y K T C A I F Q | A I F V L G L G L L | S L S S R L Y L I R | 149 |
| SEQ_ID_NO_444 | W T G T V Y Y I F S L | L G A F L S D S Y W | G R Y L T C A I F Q | A I F V L G L G L L | S L S S W R F L L I K | 138 |
| SEQ_ID_NO_431 | W T G T V Y Y I F S L | L G A F M S D S Y W | G R Y I T C A I F Q | M I Y V T G L V I L | S L A S W F L L V K | 130 |
| SEQ_ID_NO_446 | W T G T V Y Y I F S L | L G A F L S D S Y W | G R Y V T C A V F Q | I Y V M G L V V L | S L A S W L L L V K | 130 |
| SEQ_ID_NO_433 | W T G T V Y Y I F S L | L G A F L S D S Y W | G R Y V T C A I F Q | I Y V T G L V I L | S L A S W F L L V K | 130 |
| SEQ_ID_NO_426 | W T G T V Y Y I F S L | L G A F L S D S Y W | G R Y K T C A I F Q | A S F V A G L M M L | S L S T G A L L L E | 127 |
| SEQ_ID_NO_448 | W T G T V Y Y I F S L | L G A F L S D S Y W | G R Y K T C A I F Q | A S F V A G L V M L | S L S T G A L L L E | 127 |
| SEQ_ID_NO_430 | W T G T V Y Y I F S L | L G A F L S D S Y W | G R Y I T C A I F Q | V I F V V G L V A L | S L T S Y I F L L K | 125 |
| SEQ_ID_NO_428 | W T G T V Y Y I F S L | L G A F L S D S Y W | G R Y K T C A I F Q | A I F V T G L V L L | S L S S Y L F L L K | 141 |
| SEQ_ID_NO_429 | W T G T V Y Y I F S L | L G A F L S D S Y W | G R Y K T C A I F Q | V I F V I G L V L L | S L S S Y I F L L K | 125 |

| SEQ_ID_NO | | | | | | |
|---|---|---|---|---|---|---|
| SEQ_ID_NO_437 | P P S C - - I G S D | C P T A N L A Q Y G | V F F L G L Y L I A | L G T G G I K P C V | S S F G A D Q F D D | 196 |
| SEQ_ID_NO_440 | P A E C - - L G A V | C P P A T P A Q Y A | V F F I G L Y L I A | L G T G G I K P C V | S S F G A D Q F D D | 189 |
| SEQ_ID_NO_438 | P S P C - - V G S V | C P A A T P A Q Y A | V F F C G L Y L I A | L G T G G I K P C V | S S F G A D Q F D D | 187 |
| SEQ_ID_NO_439 | P P Q C - - V G S V | C P S A S P A Q Y A | L F F F G L Y L I A | L G T G G I K P C V | S S F G A D Q F D D | 184 |
| SEQ_ID_NO_435 | P A L C A S K G V - | C D F P T P G Q S A | A V F I A L Y L I A | L G T G G I K P C V | S S F G A D Q F D E | 172 |
| SEQ_ID_NO_436 | P P S G E G V A L | - - - - S S T Q L A | V F Y L A L Y L I A | L G T G G I K P C V | S S F G A D Q F D E | 173 |
| SEQ_ID_NO_442 | P D G C G M E H A P | C G P H S G K E L G | I F Y I A L Y M I A | F G N G G Y Q P N I | A T L G A D Q F D E | 194 |
| SEQ_ID_NO_447 | P V G C G T E H T P | C A S H S G T E M G | I F Y I S T Y M I A | F G Y G G H Q P T L | A T F G S D Q F D E | 199 |
| SEQ_ID_NO_444 | P V G C G N E E T T | C L E P S S V G V G | I F Y L S T Y M I A | F G N G G Y Q P S I | A T F G S D Q F D E | 188 |
| SEQ_ID_NO_431 | P T G C G A A G E H | C D A P S S A G V A | I F Y L S T Y M I A | F G N G G Y Q P S I | A T F G S D Q F D E | 180 |
| SEQ_ID_NO_446 | P S G C G G V K A H | C D G P S A P G V A | I F Y L S V Y L I A | F G N G G Y Q P N I | A T F G S D Q F D E | 180 |
| SEQ_ID_NO_433 | P S G C G V D A R | C D E P S A P G V A | I F Y L S V Y L I A | L G Y G G Y Q P N I | A T F G S D Q F D A | 180 |
| SEQ_ID_NO_426 | P S G C G V E D S P | C K P H S T F K T V | I F Y L S V V L I A | L G Y G G Y Q P N I | A T F G S D Q F D A | 177 |
| SEQ_ID_NO_448 | P S G C G V E E S P | C K P H S T V K T V | I F Y V S V Y L I A | L G N G G Y Q P T I | A T F G A D Q F D E | 177 |
| SEQ_ID_NO_430 | P N G C G S K E L P | C G T H S S Y E T T | L F Y V S I Y L V A | L G N G G Y Q P N I | A T F G A D Q F D E | 175 |
| SEQ_ID_NO_428 | P R G C G D E H S P | C G S H S T Y Q N V | F F Y F S I Y L V A | L G N G G Y Q P N I | A T F G A D Q F D E | 191 |
| SEQ_ID_NO_429 | P N G C G D K E F P | C G S H S T F E I S | F F Y L S I Y L I A | L G N G G Y Q P N I | A T F G A D Q F D E | 175 |

| | | | | | | |
|---|---|---|---|---|---|---|
| SEQ_ID_NO_437 | MSIFWQIPQY | FLVGASEVFT | FVGQLEFFYD | QSPDAMRSLC | SALSLLTTAL | 529 |
| SEQ_ID_NO_440 | LTIFLQIPQY | FLLGAAEVFT | FVGQLEFFYD | QSPDAMRSLC | SALSLLTTSL | 520 |
| SEQ_ID_NO_438 | MSILWQIPQY | FLVGASEIFT | FIGGQLEFFYD | QSPDAMRSLC | SALSLLTTAL | 518 |
| SEQ_ID_NO_439 | LSIFWQVPQY | FILGAAEIFT | FIGGQLEFFYD | QSPDAMRSLC | SALSLLTTAL | 515 |
| SEQ_ID_NO_435 | ISIFWQVPQY | FIIGAAEVFT | FVGQLEFFYD | QAPDAMRSMC | SALSLTTVAL | 501 |
| SEQ_ID_NO_436 | LTIFVQIPQY | FLIGVSEVMM | YVGQLEFFNG | QAPDAMRSLM | SALCMMSMSL | 509 |
| SEQ_ID_NO_442 | LHIMWQVPQY | ALIGVSEVMM | YVGQLEFFNG | QMPDGLKSFG | SALCMMSMSL | 519 |
| SEQ_ID_NO_447 | LHLWQVPQY | VLVGASEVFM | YVGQLEFFNG | EMPDGFKSFG | SALCMASISL | 529 |
| SEQ_ID_NO_444 | LSVFWQVPQY | ALIGASEVFM | YVGQLEFFNG | QAPDGIKSFG | SSLCMASISL | 511 |
| SEQ_ID_NO_431 | LSVLWQVPQY | ALIGASEVFM | YVGQLEFFNG | QAPDGVKSFG | SSLCMASISL | 506 |
| SEQ_ID_NO_446 | LSVLWQVPQY | MLIGASEVFM | YVGQLEFFNS | QAPDGVKSFG | SALCMASISL | 503 |
| SEQ_ID_NO_433 | LSVFWQVPQY | MMIGASEVFM | YVGQLEFFNS | QAPTGLKSFA | SALCMASISL | 506 |
| SEQ_ID_NO_426 | LSIFWQVPQY | VLIGASEVFM | YVGQLEFFNG | QAPTGLKSFA | SALCMASISL | 511 |
| SEQ_ID_NO_448 | LSIFWQVPQY | VLIGASEVFM | YVGQLEFFNG | QAPDGLKSFG | SALCMTSISL | 506 |
| SEQ_ID_NO_430 | LSILWQIPQY | VLIGASEVFM | YVGQLEFFNG | QAPDGLKSFG | SALCMTSISL | 508 |
| SEQ_ID_NO_428 | LSIFWQIPQY | VLIGASEVFM | YVGQLEFFNG | QAPDGLKSFG | SALCMTSISL | 523 |
| SEQ_ID_NO_429 | LSIFWQIPQY | VLIGASEVFM | YVGQLEFFND | QAPDGLKSFG | SALCMTSISL | 508 |

| | | | | | | |
|---|---|---|---|---|---|---|
| SEQ_ID_NO_437 | GNYLSSLIVT | IVMFATTK- G | GNLGWPDNL | NEGHLDYYFW | VLASLSVLNL | 578 |
| SEQ_ID_NO_440 | GNYLSSFILT | VVLYFTTR- G | GNPGWPDNL | NKGHLDYFFSG | -LAGLSFLNM | 568 |
| SEQ_ID_NO_438 | GNYLSSFILT | MVTITTR- G | GKPGWPDNL | NEGHLDYFFW | LLAGLSFLNL | 567 |
| SEQ_ID_NO_439 | GNYLSSFILT | VVTSITTR- G | GKPGWPDNL | LLAALSFFNL | LLAALSFFNL | 564 |
| SEQ_ID_NO_435 | GNYLSTLLVT | VVAKLTTR- G | GKQGWPDNL | NVGHLDYFFW | LLAALSLLNF | 550 |
| SEQ_ID_NO_436 | GNYSSVLVT | IVTEVTTK- G | GKPGWPNNL | NRGHLDKFYF | MLAILSILNL | 558 |
| SEQ_ID_NO_442 | GNYFSDVIVS | AVTRLTTT- R | GRSGWPADL | NEGHLDKFYF | LLAVLAVADF | 568 |
| SEQ_ID_NO_447 | GNYFSDIIVS | AVTKATAV- D | GRPGWPADL | NVGHMDRFFF | LLAILSVADF | 578 |
| SEQ_ID_NO_444 | GNYVSSLLVY | MVMGITAR- G | ENPGWPNNL | NVGHMDRFFF | LVAVLTALDF | 560 |
| SEQ_ID_NO_431 | GNYVSIMLVS | VVTSLTAG- D | RRPGWPGNL | NSGHLDRFYF | LLAALSLVDL | 555 |
| SEQ_ID_NO_446 | GNYVSIMLVS | VVTSLTAG- D | KRPGWPGNL | NSGHLDRFYF | LLAALSLVDL | 552 |
| SEQ_ID_NO_433 | GNYVSIMLVS | VVTSLTAG- E | DVHGWPENL | NKGHLERFYF | LLAGLTAADF | 555 |
| SEQ_ID_NO_426 | GNYLSSLLVS | IVMKISTT- D | DLFGWPGNL | NSGHLDRFYF | LLAALTAADF | 560 |
| SEQ_ID_NO_448 | GNYLSSLLVS | IVMKISTR- D | GMLGWPGNL | NKGHLDRFYF | LLAGLTAADF | 555 |
| SEQ_ID_NO_430 | GNYLSSLLVA | IVMKISTRNE | EMPGWPGNL | NMGHLDRFYF | LLAALTAADL | 558 |
| SEQ_ID_NO_428 | GNYVSSLLVT | VVMKISTR- D | GMPGWPSNL | NKGHLDRFFF | LLAVLTADL | 572 |
| SEQ_ID_NO_429 | GNYVSSLLVT | IVMKFSTR- D | QMPGWPSNL | NKGHLDRFYF | LLAALTMADF | 557 |

Figure 11 Continued

| SEQ_ID_NO_437 | LVYVSCAHRY | -KYKKAS--- | ---------- | ---------- | 594 |
| SEQ_ID_NO_440 | FLYIVAAKRY | -KSKKAS--- | ---------- | ---------- | 584 |
| SEQ_ID_NO_438 | VIYVFCAARY | -KCKKAS--- | ---------- | ---------- | 583 |
| SEQ_ID_NO_439 | VIYVFLCQMY | -KSKKAS--- | ---------- | ---------- | 580 |
| SEQ_ID_NO_435 | AVYLLIASWY | -TYKKTAGDD | HPDATAKGGA | HDI------- | 581 |
| SEQ_ID_NO_436 | IEYLVVAKFY | -TYKRVHNAA | DVGEDGKPSK | SGYE------ | 591 |
| SEQ_ID_NO_442 | AVYLVCASRY | -GsGKVDGRS | SDDEEEGAAG | QVITSLPAYA | 606 |
| SEQ_ID_NO_447 | AVYLVFAGRY | RKSCKVEGRS | DDEEGSVDD | EEACHA---- | 614 |
| SEQ_ID_NO_444 | VLYLLCARWY | -KSINLGDGD | MG---SQFED | EEVI--SKV | 592 |
| SEQ_ID_NO_431 | AVYVACAVWY | -KGIKLDSNE | EK---ANKI | TVHV------ | 584 |
| SEQ_ID_NO_446 | AVYVACAMWY | -KGIKLDGGD | GDN--RRKV | SAHV------ | 582 |
| SEQ_ID_NO_433 | AVYVACATWY | -KGIKLDGGG | E----TRKN | PAHV------ | 583 |
| SEQ_ID_NO_426 | VVYLICAKWY | -KYIKSEASF | SE---SVTE | EEEV------ | 589 |
| SEQ_ID_NO_448 | VVYLVCAKWY | -KYIKSEASF | SE---SLAE | EE-------- | 582 |
| SEQ_ID_NO_430 | LVYIAMARWY | -KYVKFHGNN | IEQG-NNLE | ENVV------ | 589 |
| SEQ_ID_NO_428 | VLYIICARWY | -KYIKFERQQ | EADSL-SNEE | ADLRV----- | 606 |
| SEQ_ID_NO_429 | GVYIICAKWY | -KSIKLEGKY | EDSN--SKGS | DDVMV----- | 589 |

Figure 11 Continued

TRANSGENIC PLANTS HAVING INCREASED BIOMASS

CROSS-REFERENCE TO RELATED APPLICATIONS

This application is a continuation of U.S. application Ser. No. 13/385,000, filed Jun. 11, 2012 (pending), which application is a National Stage Application under 35 U.S.C. § 371 of International Application No. PCT/US2010/042602, filed Jul. 20, 2010, which application claims the benefit of U.S. Provisional Application Ser. No. 61/226,969, filed on Jul. 20, 2009. The disclosures of the prior applications are incorporated by reference in their entirety.

TECHNICAL FIELD

This document relates to methods and materials involved in modulating biomass levels in plants. For example, this document provides plants having increased biomass levels as well as materials and methods for making plants and plant products having increased biomass levels.

BACKGROUND

The present invention relates to methods of increasing biomass in plants and plants generated thereby. Plants having increased and/or improved biomass are useful for agriculture, horticulture, biomass to energy conversion, paper production, plant product production, and other industries. In particular, there is a need for increases in biomass for dedicated energy crops such as *Panicum virgatum* L. (switchgrass), *Miscanthus×gigantus* (miscanthus), *Sorghum* sp., and *Saccharum* sp. (sugar cane). Throughout human history, access to plant biomass for both food and fuel has been essential to maintaining and increasing population levels. Scientists are continually striving to improve biomass in agricultural crops. The large amount of research related to increasing plant biomass, particularly for dedicated energy crops, indicates the level of importance placed on providing sustainable sources of energy for the population. The urgency of developing sustainable and stable sources of plant biomass for energy is underscored by current events, such as rising oil prices. The amount of biomass produced by plants is a quantitative trait affected by a number of biochemical pathways. There is a need for molecular genetic approaches to more rapidly produce plants having increased biomass. There is also a need to produce plant species that grow more efficiently and produce more biomass in various geographic and/or climatic environments. It would be desirable for such approaches to be applicable to multiple plant species (Zhang et al., *Plant Physiol.* 135: 615-621 (2004)). Despite some progress in molecular genetic approaches, there is also a need to identify specific genes and/or sequences that can be used to effectively increase biomass in plants.

SUMMARY

This document provides methods and materials related to plants having modulated levels of biomass. For example, this document provides transgenic plants and plant cells having increased levels of biomass, nucleic acids used to generate transgenic plants and plant cells having increased levels of biomass, methods for making plants having increased levels of biomass, and methods for making plant cells that can be used to generate plants having increased levels of biomass. Such plants and plant cells can be grown to produce, for example, plants having increased height, increased tiller number, or increased dry weight. Plants having increased biomass levels may be useful to produce biomass for food and feed, which may benefit both humans and animals. Plants having increased biomass levels may be useful in converting such biomass to a liquid fuel (e.g., ethanol), or other chemicals, or may be useful as a thermochemical fuel.

Methods of producing a plant having increased biomass are provided herein. In one aspect, a method comprises growing a plant cell comprising an exogenous nucleic acid. The exogenous nucleic acid comprises a regulatory region operably linked to a nucleotide sequence encoding a polypeptide. The Hidden Markov Model (HMM) bit score of the amino acid sequence of the polypeptide is greater than about 130, 340, 530, 120, 635, 65, 100, 480, 145, 280, or 1000 using an HMM generated from the amino acid sequences depicted in one of FIG. 1, 2, 3, 4, 5, 6, 7, 8, 9, 10, or 11, respectively. The plant has a difference in the level of biomass as compared to the corresponding level of biomass of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence encoding a polypeptide having 80 percent or greater sequence identity to an amino acid sequence set forth in SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. A plant produced from the plant cell can be used to generate a plant that has a difference in the level of biomass as compared to the corresponding level of biomass of a control plant that does not comprise the exogenous nucleic acid.

In another aspect, a method comprises growing a plant cell comprising an exogenous nucleic acid. The exogenous nucleic acid comprises a regulatory region operably linked to a nucleotide sequence having 80 percent or greater sequence identity to a nucleotide sequence, or a fragment thereof, set forth in SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696. A plant produced from the plant cell has a difference in the level of biomass as compared to the corresponding level of biomass of a control plant that does not comprise the exogenous nucleic acid.

Methods of modulating the level of biomass in a plant are provided herein. In one aspect, a method comprises introducing into a plant cell an exogenous nucleic acid that comprises a regulatory region operably linked to a nucleotide sequence encoding a polypeptide. The HMM bit score of the amino acid sequence of the polypeptide is greater than about 130, 340, 530, 120, 635, 65, 100, 480, 145, 280, or 1000, using an HMM generated from the amino acid sequences depicted in one of FIG. 1, 2, 3, 4, 5, 6, 7, 8, 9, 10, or 11, respectively. A plant produced from the plant cell has a difference in the level of biomass as compared to the corresponding level of biomass of a control plant that does not comprise the exogenous nucleic acid.

In certain embodiments, the HMM score of the amino acid sequence of the polypeptide is greater than about 340, using an HMM generated from the amino acid sequences depicted in FIG. 2, wherein the polypeptide comprises a Dof domain zinc finger, having at least 60 percent or greater (e.g., 65, 70, 75, 80, 85, 90, 95, 99, or 100%) sequence identity to residues 130 to 192 of SEQ ID NO: 263, or Dof domain zinc fingers identified in the sequence listing.

In certain embodiments, the HMM score of the amino acid sequence of the polypeptide is greater than about 530, using an HMM generated from the amino acid sequences depicted in FIG. 3, wherein the polypeptide comprises a pytochelatin synthetase-like domain having at least 60 percent or greater (e.g., 65, 70, 75, 80, 85, 90, 95, 99, or 100%) sequence identity to residues 44 to 208 of SEQ ID NO: 117, or pytochelatin synthetase-like domains identified in the sequence listing.

In certain embodiments, the HMM score of the amino acid sequence of the polypeptide is greater than about 120, using an HMM generated from the amino acid sequences depicted in FIG. 4, wherein the polypeptide comprises a AP2 domain having at least 60 percent or greater (e.g., 65, 70, 75, 80, 85, 90, 95, 99, or 100%) sequence identity to residues 32 to 83 of SEQ ID NO: 1, or AP2 domains identified in the sequence listing.

In certain embodiments, the HMM score of the amino acid sequence of the polypeptide is greater than about 635, using an HMM generated from the amino acid sequences depicted in FIG. 5, wherein the polypeptide comprises a Aminotransferase class I and II domain having at least 60 percent or greater (e.g., 65, 70, 75, 80, 85, 90, 95, 99, or 100%) sequence identity to residues 88 to 453 of SEQ ID NO: 645, or Aminotransferase class I and II domains identified in the sequence listing.

In certain embodiments, the HMM score of the amino acid sequence of the polypeptide is greater than about 100, using an HMM generated from the amino acid sequences depicted in FIG. 7, wherein the polypeptide comprises a Myb-like DNA-binding domain having at least 60 percent or greater (e.g., 65, 70, 75, 80, 85, 90, 95, 99, or 100%) sequence identity to residues 13 to 62 of SEQ ID NO: 323, or Myb-like DNA-binding domains identified in the sequence listing.

In certain embodiments, the HMM score of the amino acid sequence of the polypeptide is greater than about 480, using an HMM generated from the amino acid sequences depicted in FIG. 8, wherein the polypeptide comprises an alpha/beta hydrolase fold domain having at least 60 percent or greater (e.g., 65, 70, 75, 80, 85, 90, 95, 99, or 100%) sequence identity to residues 35 to 257 of SEQ ID NO: 595.

In certain embodiments, the HMM score of the amino acid sequence of the polypeptide is greater than about 145, using an HMM generated from the amino acid sequences depicted in FIG. 9, wherein the polypeptide comprises a Rapid Alkalinization Factor (RALF) domain having at least 60 percent or greater (e.g., 65, 70, 75, 80, 85, 90, 95, 99, or 100%) sequence identity to residues 57 to 129 of SEQ ID NO: 77, or RALF domains identified in the sequence listing.

In certain embodiments, the HMM score of the amino acid sequence of the polypeptide is greater than about 280, using an HMM generated from the amino acid sequences depicted in FIG. 10, wherein the polypeptide comprises a protein of unknown function (DUF640) domain having at least 60 percent or greater (e.g., 65, 70, 75, 80, 85, 90, 95, 99, or 100%) sequence identity to residues 19 to 152 of SEQ ID NO: 209, or DUF640 domains identified in the sequence listing.

In certain embodiments, the HMM score of the amino acid sequence of the polypeptide is greater than about 1000, using an HMM generated from the amino acid sequences depicted in FIG. 11, wherein the polypeptide comprises a POT family domain having at least 60 percent or greater (e.g., 65, 70, 75, 80, 85, 90, 95, 99, or 100%) sequence identity to residues 100 to 509 of SEQ ID NO: 426, or POT family domains identified in the sequence listing.

In another aspect, a method comprises introducing into a plant cell an exogenous nucleic acid that comprises a regulatory region operably linked to a nucleotide sequence encoding a polypeptide having 80 percent or greater sequence identity to an amino acid sequence set forth in SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. A plant produced from the plant cell has a difference in the level of biomass as compared to the corresponding level of biomass of a control plant that does not comprise the exogenous nucleic acid. The polypeptide in any of the above methods can have the amino acid sequence set forth in SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. In another aspect, a method comprises introducing into a plant cell an exogenous nucleic acid, that comprises a regulatory region operably linked to a nucleotide sequence having 80 percent or greater sequence identity to a nucleotide sequence set forth in SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696, or a fragment thereof. A plant produced from the plant cell has a difference in the level of biomass as compared to the corresponding level of biomass of a control plant that does not comprise the exogenous nucleic acid.

Plant cells comprising an exogenous nucleic acid are provided herein. In one aspect, the exogenous nucleic acid comprises a regulatory region operably linked to a nucleotide sequence encoding a polypeptide. The HMM bit score of the amino acid sequence of the polypeptide is greater than about 130, 340, 530, 120, 635, 65, 100, 480, 145, 280, or 1000, using an HMM based on the amino acid sequences depicted in one of FIG. 1, 2, 3, 4, 5, 6, 7, 8, 9, 10, or 11. The plant has a difference in the level of biomass as compared to the corresponding level of biomass of a control plant that does not comprise the exogenous nucleic acid. In another aspect, the exogenous nucleic acid comprises a regulatory region operably linked to a nucleotide sequence encoding a polypeptide having 80 percent or greater sequence identity to an amino acid sequence selected from the group consisting of SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. A plant produced from the plant cell has a difference in the level of biomass as compared to the corresponding level of biomass of a control plant that does not comprise the exogenous nucleic acid. In another aspect, the exogenous nucleic acid comprises a regulatory region operably linked to a nucleotide sequence having 80 percent or greater sequence identity to a nucleotide sequence selected from the group consisting of SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696, or a fragment thereof. A plant produced from the plant cell has a difference in the level of biomass as compared to the corresponding level of biomass of a control plant that does not comprise the exogenous nucleic acid. A transgenic plant comprising such a plant cell is also provided. Also provided is a plant biomass or seed product. The product comprises vegetative or embryonic tissue from a transgenic plant described herein.

Isolated nucleic acids are also provided. In one aspect, an isolated nucleic acid comprises a nucleotide sequence having 80% or greater sequence identity to the nucleotide sequence set forth in SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696. In another aspect, an isolated nucleic acid comprises a nucleotide sequence encoding a polypeptide having 80% or greater sequence identity to the amino acid sequence set forth in SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697.

In another aspect, methods of identifying a genetic polymorphism associated with variation in the level of biomass are provided. The methods include providing a population of plants, and determining whether one or more genetic polymorphisms in the population are genetically linked to the locus for a polypeptide selected from the group consisting of the polypeptides depicted in FIGS. 1-11 and functional homologs thereof. The correlation between variation in the level of biomass in a tissue in plants of the population and the presence of the one or more genetic polymorphisms in plants of the population is measured, thereby permitting identification of whether or not the one or more genetic polymorphisms are associated with such variation.

In another aspect, methods of making a plant line are provided. The methods include determining whether one or more genetic polymorphisms in a population of plants is associated with the locus for one or more of the polypeptides depicted in FIGS. 1-11 and functional homologs of such polypeptides. One or more plants in the population is identified in which the presence of at least one of the genetic polymorphism(s) is associated with variation in a biomass trait. The above-described steps can be performed in either order. One or more of the identified plants is then crossed with itself or a different plant to produce seed, and at least one progeny plant grown from such seed is crossed with itself or a different plant. The steps of selfing and outcrossing are repeated for an additional 0-5 generations to make a plant line in which the at least one polymorphism is present. The biomass trait can be yield of dry matter, and the plant population can be switchgrass plants.

This document also features a method of altering the level of biomass in a plant. The method includes modifying an endogenous biomass-modulating nucleic acid, the nucleic acid including a nucleotide sequence with an open reading frame having 80 percent or greater sequence identity to the nucleotide sequence selected from the group consisting of SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, and 696. The plant has a difference in the level of biomass as compared to the corresponding level of a control plant where the nucleic acid has not been modified. The modification can be effected by introducing a genetic modification in the locus comprising the nucleic acid. The method further can include selecting for plants having altered biomass.

In some embodiments, the endogenous nucleic acid encodes a polypeptide having 80 percent or greater sequence identity to an amino acid sequence selected from the group consisting of SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, and 697.

In some embodiments, the endogenous nucleic acid comprises a nucleotide sequence with an open reading frame having 90 percent or greater sequence identity to the nucleotide sequence selected from the group consisting of SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, and 696.

In some embodiments, the endogenous nucleic acid comprises a nucleotide sequence with an open reading frame having 95 percent or greater sequence identity to the nucleotide sequence selected from the group consisting of SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, and 696.

This document also features a method of producing a plant. The method includes growing a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-11, and wherein the plant has a difference in the level of biomass as compared to the corresponding level of a control plant where the nucleic acid has not been modified.

In another aspect, this document features a plant cell containing a modified endogenous nucleic acid encoding a polypeptide, wherein the HMM bit score of the amino acid sequence of the polypeptide is greater than about 65, the HMM based on the amino acid sequences depicted in one of FIGS. 1-11, and wherein a plant produced from the plant cell has a difference in the level of biomass as compared to the corresponding level of a control plant where the nucleic acid has not been modified.

This document also features a plant cell containing a modified biomass-modulating endogenous nucleic acid. The nucleic acid comprising a nucleotide sequence with an open reading frame having 80 percent or greater sequence identity to the nucleotide sequence selected from the group consisting of SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, and 696. A plant produced from the plant cell has a difference in the level of biomass as compared to the corresponding level of a control plant where the nucleic acid has not been modified. In a plant cell described herein, the endogenous nucleic acid can encode a polypeptide having 80 percent or greater sequence identity to an amino acid sequence selected from the group consisting of SEQ ID NO: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, and 697, and wherein a plant produced from the plant cell has a difference in the level of biomass as compared to the corresponding level of a control plant where the nucleic acid has not been modified.

In another aspect, this document features a method of modulating the level of biomass in a plant. The method includes introducing into a plant cell an exogenous nucleic acid, the exogenous nucleic acid encoding a polypeptide having E.C. 2.6.1.83 activity.

A plant cell also is featured that includes an exogenous nucleic acid, where the exogenous nucleic acid encodes a polypeptide having E.C. 2.6.1.83 activity, and wherein a plant produced from the plant cell has a difference in the level of biomass as compared to the corresponding level of a control plant that does not comprise the nucleic acid.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims. The word "comprising" in the claims may be replaced by "consisting essentially of" or with "consisting of," according to standard practice in patent law.

DESCRIPTION OF THE DRAWINGS

FIG. 1 is an alignment of the amino acid sequence of CW00733 corresponding to Ceres Clone: 1384304 (SEQ ID NO: 554) with homologous and/or orthologous amino acid sequences. In all the alignment figures shown herein, a dash in an aligned sequence represents a gap, i.e., a lack of an amino acid at that position. Identical amino acids or conserved amino acid substitutions among aligned sequences are identified by boxes. FIG. 1 and the other alignment figures provided herein were generated using the program MUSCLE version 3.52.

FIG. 2 is an alignment of the amino acid sequence of CW00319 corresponding to Ceres Annot: 544549 (SEQ ID NO: 263) with homologous and/or orthologous amino acid sequences.

FIG. 3 is an alignment of the amino acid sequence of CW00710 corresponding to Ceres Annot: 1355066 (SEQ ID NO: 117) with homologous and/or orthologous amino acid sequences.

FIG. 4 is an alignment of the amino acid sequence of CW00628 corresponding to an antisense sequence of Os01g58420, (SEQ ID NO: 1) with homologous and/or orthologous amino acid sequences.

FIG. 5 is an alignment of the amino acid sequence of CW00297 corresponding to Ceres Clone: 625057 (SEQ ID NO: 645) with homologous and/or orthologous amino acid sequences.

FIG. 6 is an alignment of the amino acid sequence of CW00604 corresponding to Ceres Clone: 1356785 (SEQ ID NO: 253) with homologous and/or orthologous amino acid sequences.

FIG. 7 is an alignment of the amino acid sequence of CW00564 corresponding to Ceres Clone: 638126 (SEQ ID NO: 323) with homologous and/or orthologous amino acid sequences.

FIG. 8 is an alignment of the amino acid sequence of CW00010 corresponding to Ceres Clone: 26006 (SEQ ID NO: 595) with homologous and/or orthologous amino acid sequences.

FIG. 9 is an alignment of the amino acid sequence of CW00469 corresponding to Ceres Clone: 4831 (SEQ ID NO: 77) with homologous and/or orthologous amino acid sequences.

FIG. 10 is an alignment of the amino acid sequence of CW00536 corresponding to Ceres Annot: 847799 (SEQ ID NO: 209) with homologous and/or orthologous amino acid sequences.

FIG. 11 is an alignment of the amino acid sequence of CW00191 corresponding to Ceres Annot: 878355 (SEQ ID NO: 426) with homologous and/or orthologous amino acid sequences.

DETAILED DESCRIPTION

The invention features methods and materials related to modulating biomass levels in plants. In some embodiments, the plants may also have modulated levels of, for example, lignin, modified root architecture, modified herbicide resistance, modified carotenoid biosynthesis, or modulated cell wall content. The methods can include transforming a plant cell with a nucleic acid encoding a biomass-modulating polypeptide, wherein expression of the polypeptide results in a modulated level of biomass. Plant cells produced using such methods can be grown to produce plants having an increased or decreased biomass. Such plants, and the seeds of such plants, may be used to produce, for example, biomass having an increased value as a biofuel feedstock.

I. DEFINITIONS

"Amino acid" refers to one of the twenty biologically occurring amino acids and to synthetic amino acids, including D/L optical isomers.

"Cell type-preferential promoter" or "tissue-preferential promoter" refers to a promoter that drives expression preferentially in a target cell type or tissue, respectively, but may also lead to some transcription in other cell types or tissues as well.

"Control plant" refers to a plant that does not contain the exogenous nucleic acid present in a transgenic plant of interest, but otherwise has the same or similar genetic background as such a transgenic plant. A suitable control plant can be a non-transgenic wild type plant, a non-transgenic segregant from a transformation experiment, or a transgenic plant that contains an exogenous nucleic acid other than the exogenous nucleic acid of interest.

"Domains" are groups of substantially contiguous amino acids in a polypeptide that can be used to characterize protein families and/or parts of proteins. Such domains have a "fingerprint" or "signature" that can comprise conserved primary sequence, secondary structure, and/or three-dimensional conformation. Generally, domains are correlated with specific in vitro and/or in vivo activities. A domain can have a length of from 10 amino acids to 400 amino acids, e.g., 10 to 50 amino acids, or 25 to 100 amino acids, or 35 to 65 amino acids, or 35 to 55 amino acids, or 45 to 60 amino acids, or 200 to 300 amino acids, or 300 to 400 amino acids.

"Down-regulation" refers to regulation that decreases production of expression products (mRNA, polypeptide, or both) relative to basal or native states.

"Exogenous" with respect to a nucleic acid indicates that the nucleic acid is part of a recombinant nucleic acid construct, or is not in its natural environment. For example, an exogenous nucleic acid can be a sequence from one species introduced into another species, i.e., a heterologous nucleic acid. Typically, such an exogenous nucleic acid is introduced into the other species via a recombinant nucleic acid construct. An exogenous nucleic acid can also be a sequence that is native to an organism and that has been reintroduced into cells of that organism. An exogenous nucleic acid that includes a native sequence can often be distinguished from the naturally occurring sequence by the presence of non-natural sequences linked to the exogenous nucleic acid, e.g., non-native regulatory sequences flanking a native sequence in a recombinant nucleic acid construct. In addition, stably transformed exogenous nucleic acids typically are integrated at positions other than the position where the native sequence is found. It will be appreciated that an exogenous nucleic acid may have been introduced into a progenitor and not into the cell under consideration. For example, a transgenic plant containing an exogenous nucleic acid can be the progeny of a cross between a stably transformed plant and a non-transgenic plant. Such progeny are considered to contain the exogenous nucleic acid.

"Expression" refers to the process of converting genetic information of a polynucleotide into RNA through transcription, which is catalyzed by an enzyme, RNA polymerase, and into protein, through translation of mRNA on ribosomes.

"Heterologous polypeptide" as used herein refers to a polypeptide that is not a naturally occurring polypeptide in a plant cell, e.g., a transgenic *Panicum virgatum* plant transformed with and expressing the coding sequence for a nitrogen transporter polypeptide from a *Zea mays* plant.

"Isolated nucleic acid" as used herein includes a naturally-occurring nucleic acid, provided one or both of the sequences immediately flanking that nucleic acid in its naturally-occurring genome is removed or absent. Thus, an isolated nucleic acid includes, without limitation, a nucleic acid that exists as a purified molecule or a nucleic acid molecule that is incorporated into a vector or a virus. A nucleic acid existing among hundreds to millions of other nucleic acids within, for example, cDNA libraries, genomic libraries, or gel slices containing a genomic DNA restriction digest, is not to be considered an isolated nucleic acid.

"Modulation" of the level of biomass refers to the change in the level of the biomass that is observed as a result of expression of, or transcription from, an exogenous nucleic acid in a plant cell and/or plant. The change in level is measured relative to the corresponding level in control plants.

"Nucleic acid" and "polynucleotide" are used interchangeably herein, and refer to both RNA and DNA, including cDNA, genomic DNA, synthetic DNA, and DNA or RNA containing nucleic acid analogs. A nucleic acid can be double-stranded or single-stranded (i.e., a sense strand or an antisense strand). Non-limiting examples of polynucleotides include genes, gene fragments, exons, introns, messenger RNA (mRNA), transfer RNA, ribosomal RNA, siRNA, micro-RNA, ribozymes, cDNA, recombinant polynucleotides, branched polynucleotides, nucleic acid probes and nucleic acid primers. A polynucleotide may contain unconventional or modified nucleotides.

"Operably linked" refers to the positioning of a regulatory region and a sequence to be transcribed in a nucleic acid so that the regulatory region is effective for regulating transcription or translation of the sequence. For example, to operably link a coding sequence and a regulatory region, the translation initiation site of the translational reading frame of the coding sequence is typically positioned between one and about fifty nucleotides downstream of the regulatory region. A regulatory region can, however, be positioned as much as about 5,000 nucleotides upstream of the translation initiation site, or about 2,000 nucleotides upstream of the transcription start site.

"Polypeptide" as used herein refers to a compound of two or more subunit amino acids, amino acid analogs, or other peptidomimetics, regardless of post-translational modification, e.g., phosphorylation or glycosylation. The subunits may be linked by peptide bonds or other bonds such as, for example, ester or ether bonds. Full-length polypeptides, truncated polypeptides, point mutants, insertion mutants, splice variants, chimeric proteins, and fragments thereof are encompassed by this definition.

"Progeny" includes descendants of a particular plant or plant line. Progeny of an instant plant include seeds formed on $F_1$, $F_2$, $F_3$, $F_4$, $F_5$, $F_6$ and subsequent generation plants, or seeds formed on $BC_1$, $BC_2$, $BC_3$, and subsequent generation plants, or seeds formed on $F_1BC_1$, $F_1BC_2$, $F_1BC_3$, and subsequent generation plants. The designation $F_1$ refers to the progeny of a cross between two parents that are genetically distinct. The designations $F_2$, $F_3$, $F_4$, $F_5$ and $F_6$ refer to subsequent generations of self- or sib-pollinated progeny of an $F_1$ plant.

"Regulatory region" refers to a nucleic acid having nucleotide sequences that influence transcription or translation initiation and rate, and stability and/or mobility of a transcription or translation product. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, introns, and combinations thereof. A regulatory region typically comprises at least a core (basal) promoter. A regulatory region also may include at least one control element, such as an enhancer sequence, an upstream element or an upstream activation region (UAR). For example, a suitable enhancer is a cis-regulatory element (-212 to -154) from the upstream region of the octopine synthase (ocs) gene. Fromm et al., *The Plant Cell*, 1:977-984 (1989).

"Up-regulation" refers to regulation that increases the level of an expression product (mRNA, polypeptide, or both) relative to basal or native states.

"Vector" refers to a replicon, such as a plasmid, phage, or cosmid, into which another DNA segment may be inserted so as to bring about the replication of the inserted segment. Generally, a vector is capable of replication when associated with the proper control elements. The term "vector" includes cloning and expression vectors, as well as viral vectors and integrating vectors. An "expression vector" is a vector that includes a regulatory region.

II. POLYPEPTIDES

Polypeptides described herein include biomass-modulating polypeptides. Biomass-modulating polypeptides can be effective to modulate biomass levels when expressed in a plant or plant cell. Such polypeptides typically contain at least one domain indicative of biomass-modulating polypeptides, as described in more detail herein. biomass-modulating polypeptides typically have an HMM bit score that is greater than 65 as described in more detail herein. In some embodiments, biomass-modulating polypeptides have greater than 80% identity to SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697, as described in more detail herein.

A. Domains Indicative of Biomass-Modulating Polypeptides

A biomass-modulating polypeptide can contain a Dof domain-zinc finger (zf-Dof), which is predicted to be characteristic of a biomass-modulating polypeptide. SEQ ID NO: 263 sets forth the amino acid sequence of an *Arabidopsis* clone, identified herein as Ceres Annot: 544549 (SEQ ID NO: 262), that is predicted to encode a polypeptide containing a Dof domain-zinc finger. For example, a biomass-modulating polypeptide can comprise a Dof domain-zinc finger having 60 percent or greater sequence identity to residues 130 to 192 of SEQ ID NO: 263. In some embodiments, a biomass-modulating polypeptide can comprise a Dof domain-zinc finger having 60 percent or greater sequence identity to the Dof domain-zinc finger of one or more of the polypeptides set forth in SEQ ID NOs: 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, or 321. The Dof domain-zinc fingers of such sequences are set forth in the Sequence Listing. Zinc finger (Znf) domains are relatively small protein motifs that bind one or more zinc atoms, and which usually contain multiple finger-like protrusions that make tandem contacts with their target molecule. They were first identified as a DNA-binding motif in transcription factor TFIIIA from *Xenopus laevis*, however they are now recognized to bind DNA, RNA, protein and/or lipid substrates. Their binding properties depend on the amino acid sequence of the finger domains and of the linker between fingers, as well as on the higher-order structures and the number of fingers. Znf domains are often found in clusters, where fingers can have different binding specificities. There are many superfamilies of Znf motifs, varying in both sequence and structure. They display considerable versatility in binding modes, (e.g. some bind DNA, others protein), suggesting that Znf motifs are stable scaffolds that have evolved specialized functions. For example, Znf-containing proteins function in gene transcription, translation, mRNA trafficking, cytoskeleton organization, epithelial development, cell adhesion, protein folding, chromatin remodeling and zinc sensing, to name but a few. Zinc-binding motifs are stable structures, and they rarely undergo conformational changes upon binding their target. DOF 1.3 orthologs may contain Dof domain-zinc fingers.

A biomass-modulating polypeptide can contain a phytochelatin synthetase-like domain, which is predicted to be characteristic of a biomass-modulating polypeptide. SEQ ID NO: 117 sets forth the amino acid sequence of an *Arabidopsis* clone, identified herein as Ceres Annot: 1355066 (SEQ ID NO: 116) that is predicted to encode a polypeptide containing a phytochelatin synthetase-like domain domain. For example, a biomass-modulating polypeptide can comprise a phytochelatin synthetase-like domain domain having 60 percent or greater sequence identity to residues 44 to 208 of SEQ ID NO: 117. In some embodiments, a biomass-modulating polypeptide can comprise a phytochelatin synthetase-like domain domain having 60 percent or greater sequence identity to the phytochelatin synthetase-like domain domain of one or more of the polypeptides set forth in SEQ ID NOs: 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, or 207. The phytochelatin synthetase-like domain domains of such sequences are set forth in the Sequence Listing. Phytochelatin synthase-like protein may be an enzyme responsible for the synthesis of heavy-metal-binding peptides (phytochelatins) from glutathione and related thiols. The enzyme typically catalyses the deglycination of a GSH donor molecule. The enzyme typically contains a catalytic triad of cysteine, histidine and aspartate residues.

A biomass-modulating polypeptide can contain an AP2 domain, which is predicted to be characteristic of a biomass-modulating polypeptide. SEQ ID NO: 1 sets forth the amino acid sequence of an *Oryza sativa* clone, identified herein as Os01g58420 that is predicted to encode a polypeptide containing a AP2 domain. For example, a biomass-modulating polypeptide can comprise a AP2 domain having 60 percent or greater sequence identity to residues 32 to 83 of SEQ ID NO: 1. In some embodiments, a biomass-modulating polypeptide can comprise a AP2 domain having 60 percent or greater sequence identity to the AP2 domain of one or more of the polypeptides set forth in SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, or 75. The AP2 domains of such sequences are set forth in the Sequence Listing. In some embodiments, an antisense sequence is expressed in a plant to modulate biomass as described herein. For example, an antisense nucleic acid sequence of Os01g58420 such as SEQ ID NO: 678, can be expressed in a plant to modulate biomass. AP2 domain amino acid residues can bind to DNA and are typically found in transcription factor proteins.

A biomass-modulating polypeptide can contain an Aminotransferase class I and II domain, which is predicted to be characteristic of a biomass-modulating polypeptide. SEQ ID NO: 645 sets forth the amino acid sequence of an *Glycine max* clone, identified herein as Ceres Clone: 625057 (SEQ ID NO: 644), that is predicted to encode a polypeptide containing a Aminotransferase class I and II domain. For example, a biomass-modulating polypeptide can comprise an Aminotransferase class I and II domain having 60 percent or greater sequence identity to residues 88 to 453 of SEQ ID NO: 645. In some embodiments, a biomass-modulating polypeptide can comprise a Aminotransferase class I and II domain having 60 percent or greater sequence identity to the Aminotransferase class I and II domain of one or more of the polypeptides set forth in SEQ ID NOs: 645, 647, 649, 651, 652, 653, 655, 657, 659, 660, 662, 664, 666, 667, 669, 670, 671, 672, 673, 674, 675, 676, 677, or 689. The Aminotransferase class I and II domains of such sequences are set forth in the Sequence Listing. Aminotransferases share certain mechanistic features with other pyridoxal-phosphate dependent enzymes, such as the covalent binding of the pyridoxal-phosphate group to a lysine residue. On the basis of sequence similarity, these various enzymes can be grouped into class I and class II. Examples of polypeptides comprising Aminotransferase class I and II domains include LL-DAP polypeptides (EC 2.6.1.83) (Watanabe et al., Mechanism of Substrate Recognition and PLP-induced Conformational Changes in LL-Diaminopimelate aminotransferase from *Arabidopsis thaliana*. *J. Mol. Biol.* 384, 1314-1329 (2008)). LL-DAP catalyzes the interconversion of LL-2,6-diaminoheptanedioate and 2-oxoglutarate to (S)-2,3,4,5-tetrahydropyridine-2,6-dicarboxylate, L-glutamate, and water.

A biomass-modulating polypeptide can contain a Myb-like DNA-binding domain, which is predicted to be characteristic of a biomass-modulating polypeptide. SEQ ID NO: 323 sets forth the amino acid sequence of an *Glycine max* clone, identified herein as Ceres Clone: 638126 (SEQ ID NO: 321), that is predicted to encode a polypeptide containing a Myb-like DNA-binding domain. For example, a biomass-modulating polypeptide can comprise a Myb-like DNA-binding domain having 60 percent or greater sequence identity to residues 13 to 62 of SEQ ID NO: 323. In some embodiments, a biomass-modulating polypeptide can comprise a Myb-like DNA-binding domain having 60 percent or greater sequence identity to the Myb-like DNA-binding domain of one or more of the polypeptides set forth in SEQ ID NOs: 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, or 424. The Myb-like DNA-binding domains of such sequences are set forth in the Sequence Listing. The Myb-like DNA-binding domain family contains the DNA binding domains from Myb proteins, as well as the SANT domain family.

A biomass-modulating polypeptide can contain an alpha/beta hydrolase fold domain, which is predicted to be characteristic of a biomass-modulating polypeptide. SEQ ID NO: 595 sets forth the amino acid sequence of an *Arabidopsis* clone, identified herein as Ceres Clone: 26006 (SEQ ID NO: 594), that is predicted to encode a polypeptide containing an alpha/beta hydrolase fold domain. For example, a biomass-modulating polypeptide can comprise an alpha/beta hydrolase fold domain having 60 percent or greater sequence identity to residues 35 to 257 of SEQ ID NO: 595. In some embodiments, a biomass-modulating polypeptide can comprise an alpha/beta hydrolase fold domain having 60 percent or greater sequence identity to the alpha/beta hydrolase fold domain of one or more of the polypeptides set forth in SEQ ID NOs: 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, or 691. The alpha/beta hydrolase fold domains of such sequences are set forth in the Sequence Listing. The alpha/beta hydrolase fold is common to a number of hydrolytic enzymes of widely differing phylogenetic origin and catalytic function. The core of each enzyme is an alpha/beta-sheet (rather than a barrel), containing 8 strands connected by helices. The enzymes are believed to have diverged from a common ancestor, preserving the arrangement of the catalytic residues. All have a catalytic triad, the elements of which are borne on loops, which are the best conserved structural features of the fold.

A biomass-modulating polypeptide can contain a Rapid Alkalinization Factor (RALF) domain, which is predicted to be characteristic of a biomass-modulating polypeptide. SEQ ID NO: 77 sets forth the amino acid sequence of an *Arabidopsis* clone, identified herein as Ceres Clone: 4831 (SEQ ID NO: 76), that is predicted to encode a polypeptide containing a RALF domain. For example, a biomass-modulating polypeptide can comprise a RALF domain having 60 percent or greater sequence identity to residues 57 to 129 of SEQ ID NO: 77. In some embodiments, a biomass-modulating polypeptide can comprise a RALF domain having 60 percent or greater sequence identity to the RALF domain of one or more of the polypeptides set forth in SEQ ID NOs: 77, 79, 81, 82, 84, 86, 87, 88, 90, 92, 94, 96, 98, 100, 102, 104, 106, 108, 110, 112, 114, or 115. The RALF domains of such sequences are set forth in the Sequence Listing. RALF domains are typically found in 5-kDa ubiquitous polypeptides in plants, which have been reported to play a role in the arrest of root growth and development in some plants.

A biomass-modulating polypeptide can contain a DUF640 domain, which is predicted to be characteristic of a biomass-modulating polypeptide. SEQ ID NO: 209 sets forth the amino acid sequence of an *Arabidopsis* clone, identified herein as Ceres Annot: 847799 (SEQ ID NO: 208), that is predicted to encode a polypeptide containing a DUF640 domain. For example, a biomass-modulating polypeptide can comprise a DUF640 domain having 60 percent or greater sequence identity to residues 19 to 152 of SEQ ID NO: 209. In some embodiments, a biomass-modulating polypeptide can comprise a DUF640 domain having 60 percent or greater sequence identity to the DUF640 domain of one or more of the polypeptides set forth in SEQ ID NOs: 209, 210, 212, 214, 216, 218, 220, 222, 224, 226, 228, 230, 232, 234, 236, 238, 239, 241, 242, 243, 244, 245, 246, 247, 248, 249, 250, or 251. The DUF640 domains of such sequences are set forth in the Sequence Listing.

A biomass-modulating polypeptide can contain a PTR2 POT family domain, which is predicted to be characteristic of a biomass-modulating polypeptide. SEQ ID NO: 426 sets forth the amino acid sequence of an *Arabidopsis* clone, identified herein as Ceres Annot: 878355 (SEQ ID NO: 425), that is predicted to encode a polypeptide containing a PTR2 POT family domain. For example, a biomass-modulating polypeptide can comprise a PTR2 POT family domain having 60 percent or greater sequence identity to residues 100 to 509 of SEQ ID NO: 426. In some embodiments, a biomass-modulating polypeptide can comprise a PTR2 POT family domain having 60 percent or greater sequence identity to the PTR2 POT family domain of one or more of the polypeptides set forth in SEQ ID NOs: 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 693, 695, or 697. The PTR2 POT family domains of such sequences are set forth in the Sequence Listing. The transport of peptides into cells is a well-documented biological phenomenon which is accomplished by specific, energy-dependent transporters found in a number of organisms as diverse as bacteria and humans. The PTR family of proteins is distinct from the ABC-type peptide transporters and was uncovered by sequence analyses of a number of recently discovered peptide transport proteins. These proteins seem to be mainly involved in the intake of small peptides with the concomitant uptake of a proton. In some embodiments, a POT protein as described herein can comprise an N-terminus signal peptide. In some embodiments, the signal peptide may be specific for a plasma membrane. In some embodiments, the signal peptide may be specific for a endoplasmic reticulum membrane or a chloroplast membrane. Examples of signal peptides are shown in the Sequence Listing of the application. Bioinformatics techniques can be employed to predict the presence and type of transit peptides. These approaches do not rely exclusively on sequence similarity. Because orthologous proteins more often have the same localization, the degree of sequence similarity needed to infer co-localization is higher than for similar three-dimensional structure, and isoforms of the same protein may have different localization. WoLF PSORT can be used to predict signal peptides (Horton et al., 2007 "WoLF PSORT: Protein Localization Predictor", Nucleic Acids Research, doi: 10.1093/nar/gkm259, 2007; Horton et al., 2006 "Protein Subcellular Localization Prediction with WoLF PSORT", Proceedings of the 4th Annual Asia Pacific Bioinformatics Conference APBC06, Taipei, Taiwan. pp. 39-48, 2006). Examples of signal peptides from sequences in the public domain can be obtained from a WoLF PSORT analysis of a sequence which provides numerous orthologous signal peptides.

In eukaryotic organisms, there are several types of signal peptides and related sorting signals all of which involve membrane translocation and/or insertion. Typically, signal peptides specific for the endoplasmic reticulum (ER) are co-translational, whereas signal peptides specific for the mitochondria or chloroplast are post-translational, but unfolded by chaperones. For example, an N-terminal signal with variable length hydrophobic section, causes proteins to be co-translationally transported through or into the endoplasmic reticulum membrane. N-terminal signals are mostly independent of carrier proteins. Such signal peptides are typically interchangeable between different proteins, are typically cleaved, and are typically limited to about the first 90 amino acid residues. Cleavage, presence on N-terminal, and co-translational recognition make signal peptides typically orthogonal to protein function, but this is a general relationship. In some embodiments, a POT protein as described herein can comprise a C-terminal sorting signal. Examples of C-terminal sorting signals include, but are not limited to, KDEL (soluble) or KKXX (membrane protein) signal for ER retention, SKL for peroxisomal targeting (soluble), NPIR for vacuole, and LPXTG for bacterial cell wall. In some embodiments, a POT protein as described herein can comprise an internal sorting signal. Such signals include nuclear localization signals that occur on the surface of a folded protein but can be anywhere on the 1-dimensional sequence. In some embodiments, a POT protein as described herein can comprise an N-terminus signal peptide that is about 95, 90, 85, 80, 75, 70, 65, 60, 55, 50, 45, 40, 35, 30, 25, 20, 15, 10, or 5 amino acids in length beginning from the N-terminus of said POT protein. In some embodiments, a POT protein as described herein is lacking all or part of an N-terminus signal peptide. In some embodiments, a POT protein as described herein can have an N-terminus signal peptide removed and replaced with a different an N-terminus signal peptide. For example, one skilled in the art can remove or synthesize a sequence without the 45 N-terminus amino acids of SEQ ID NO: (426) and add, through fusion techniques or through synthesis, another signal peptide with specificity for the same or a different target membrane.

In some embodiments, a biomass-modulating polypeptide is truncated at the amino- or carboxy-terminal end of a naturally occurring polypeptide. A truncated polypeptide may retain certain domains of the naturally occurring polypeptide while lacking others. Thus, length variants that are up to 5 amino acids shorter or longer typically exhibit the biomass-modulating activity of a truncated polypeptide. In some embodiments, a truncated polypeptide is a dominant negative polypeptide. Expression in a plant of such a truncated polypeptide confers a difference in the level of biomass of a plant as compared to the corresponding level of a control plant that does not comprise the truncation.

B. Functional Homologs Identified by Reciprocal BLAST

In some embodiments, one or more functional homologs of a reference biomass-modulating polypeptide defined by one or more of the Pfam descriptions indicated above are suitable for use as biomass-modulating polypeptides. A functional homolog is a polypeptide that has sequence similarity to a reference polypeptide, and that carries out one or more of the biochemical or physiological function(s) of the reference polypeptide. A functional homolog and the reference polypeptide may be natural occurring polypeptides, and the sequence similarity may be due to convergent or divergent evolutionary events. As such, functional homologs are sometimes designated in the literature as homologs, or orthologs, or paralogs. Variants of a naturally occurring functional homolog, such as polypeptides encoded by mutants of a wild type coding sequence, may themselves be functional homologs. Functional homologs can also be created via site-directed mutagenesis of the coding sequence for a biomass-modulating polypeptide, or by combining domains from the coding sequences for different naturally-occurring biomass-modulating polypeptides ("domain swapping"). The term "functional homolog" is sometimes applied to the nucleic acid that encodes a functionally homologous polypeptide.

Functional homologs can be identified by analysis of nucleotide and polypeptide sequence alignments. For example, performing a query on a database of nucleotide or polypeptide sequences can identify homologs of biomass-modulating polypeptides. Sequence analysis can involve BLAST, Reciprocal BLAST, or PSI-BLAST analysis of nonredundant databases using a biomass-modulating polypeptide amino acid sequence as the reference sequence. Amino acid sequence is, in some instances, deduced from the nucleotide sequence. Those polypeptides in the database that have greater than 40% sequence identity are candidates for further evaluation for suitability as a biomass-modulating polypeptide. Amino acid sequence similarity allows for conservative amino acid substitutions, such as substitution of one hydrophobic residue for another or substitution of one polar residue for another. If desired, manual inspection of such candidates can be carried out in order to narrow the number of candidates to be further evaluated. Manual inspection can be performed by selecting those candidates that appear to have domains present in biomass-modulating polypeptides, e.g., conserved functional domains.

Conserved regions can be identified by locating a region within the primary amino acid sequence of a biomass-modulating polypeptide that is a repeated sequence, forms some secondary structure (e.g., helices and beta sheets), establishes positively or negatively charged domains, or represents a protein motif or domain. See, e.g., the Pfam web site describing consensus sequences for a variety of protein motifs and domains on the World Wide Web at sanger.ac.uk/Software/Pfam/and pfam.janelia.org/. A description of the information included at the Pfam database is described in Sonnhammer et al., *Nucl. Acids Res.*, 26:320-322 (1998); Sonnhammer et al., *Proteins*, 28:405-420 (1997); and Bateman et al., *Nucl. Acids Res.*, 27:260-262 (1999). Conserved regions also can be determined by aligning sequences of the same or related polypeptides from closely related species. Closely related species preferably are from the same family. In some embodiments, alignment of sequences from two different species is adequate.

Typically, polypeptides that exhibit at least about 40% amino acid sequence identity are useful to identify conserved regions. Conserved regions of related polypeptides exhibit at least 45% amino acid sequence identity (e.g., at least 50%, at least 60%, at least 70%, at least 80%, or at least 90% amino acid sequence identity). In some embodiments, a conserved region exhibits at least 92%, 94%, 96%, 98%, or 99% amino acid sequence identity.

Figure 1:
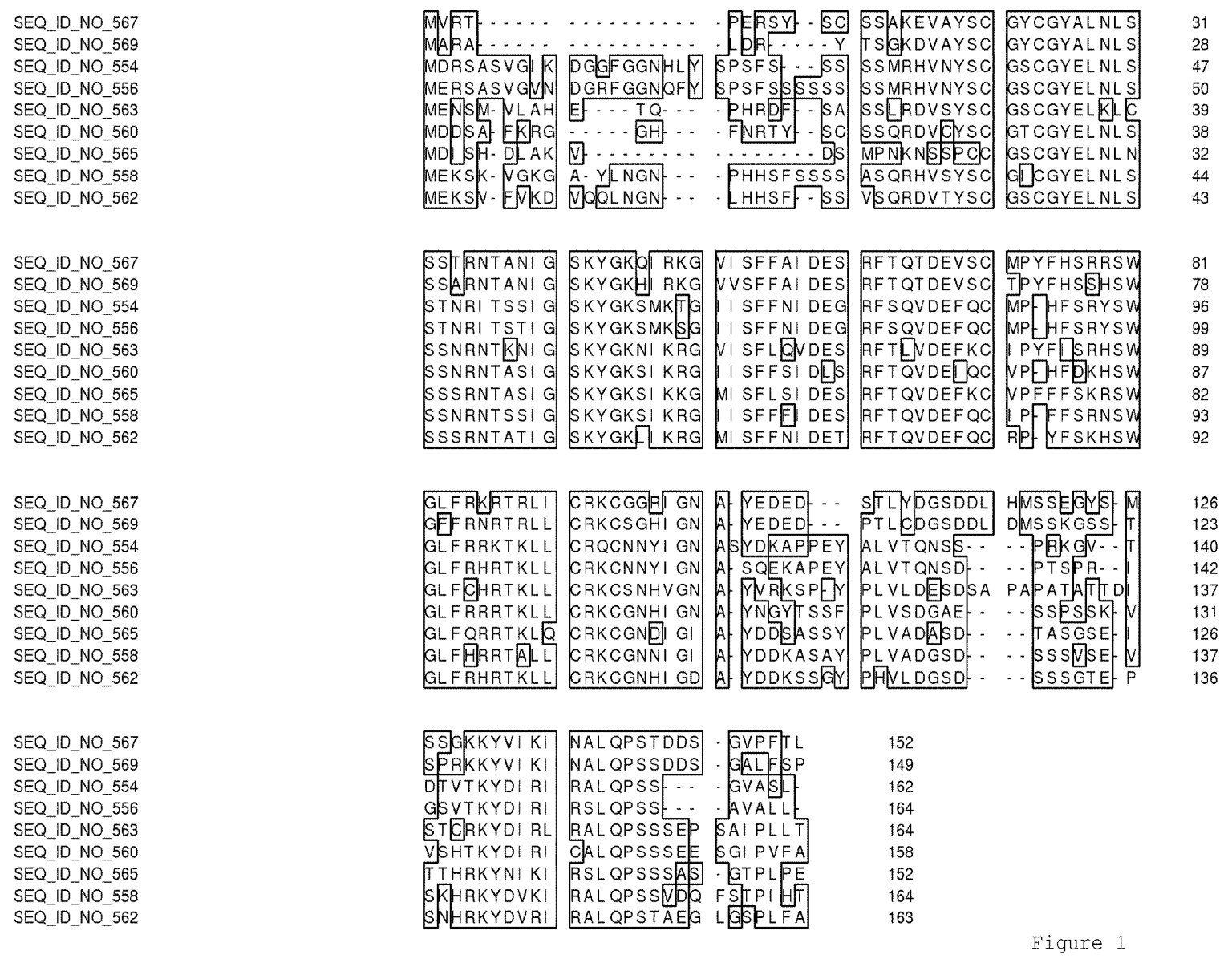

Examples of amino acid sequences of functional homologs of the polypeptide set forth in SEQ ID NO: 554 are provided in FIG. 1 and in the Sequence Listing. Such functional homologs include, for example, CeresAnnot: 564098 (SEQ ID NO: 556), CeresAnnot: 1443290 (SEQ ID NO: 558), CeresClone: 1042157 (SEQ ID NO: 560), CeresClone: 1919714 (SEQ ID NO: 562), GI: 157336039 (SEQ ID NO: 563), CeresAnnot: 8454153 (SEQ ID NO: 565), CeresAnnot: 1722302 (SEQ ID NO: 567), CeresAnnot: 8733140 (SEQ ID NO: 569), CeresAnnot: 1452096 (SEQ ID NO: 571), CeresClone: 1645639 (SEQ ID NO: 573), GI: 157344920 (SEQ ID NO: 574), GI: 115440865 (SEQ ID NO: 575), CeresClone: 340925 (SEQ ID NO: 577), CeresAnnot: 8669404 (SEQ ID NO: 579), CeresClone: 100028078 (SEQ ID NO: 581), CeresAnnot: 1503869 (SEQ ID NO: 583), CeresAnnot: 1525651 (SEQ ID NO: 585), CeresClone: 2031281 (SEQ ID NO: 587), CeresClonc: 483742 (SEQ ID NO: 589), CeresClone: 100802111 (SEQ ID NO: 591), or CeresClone: 1460255 (SEQ ID NO: 593). In some cases, a functional homolog of SEQ ID NO: 554 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 554.

Figure 2:
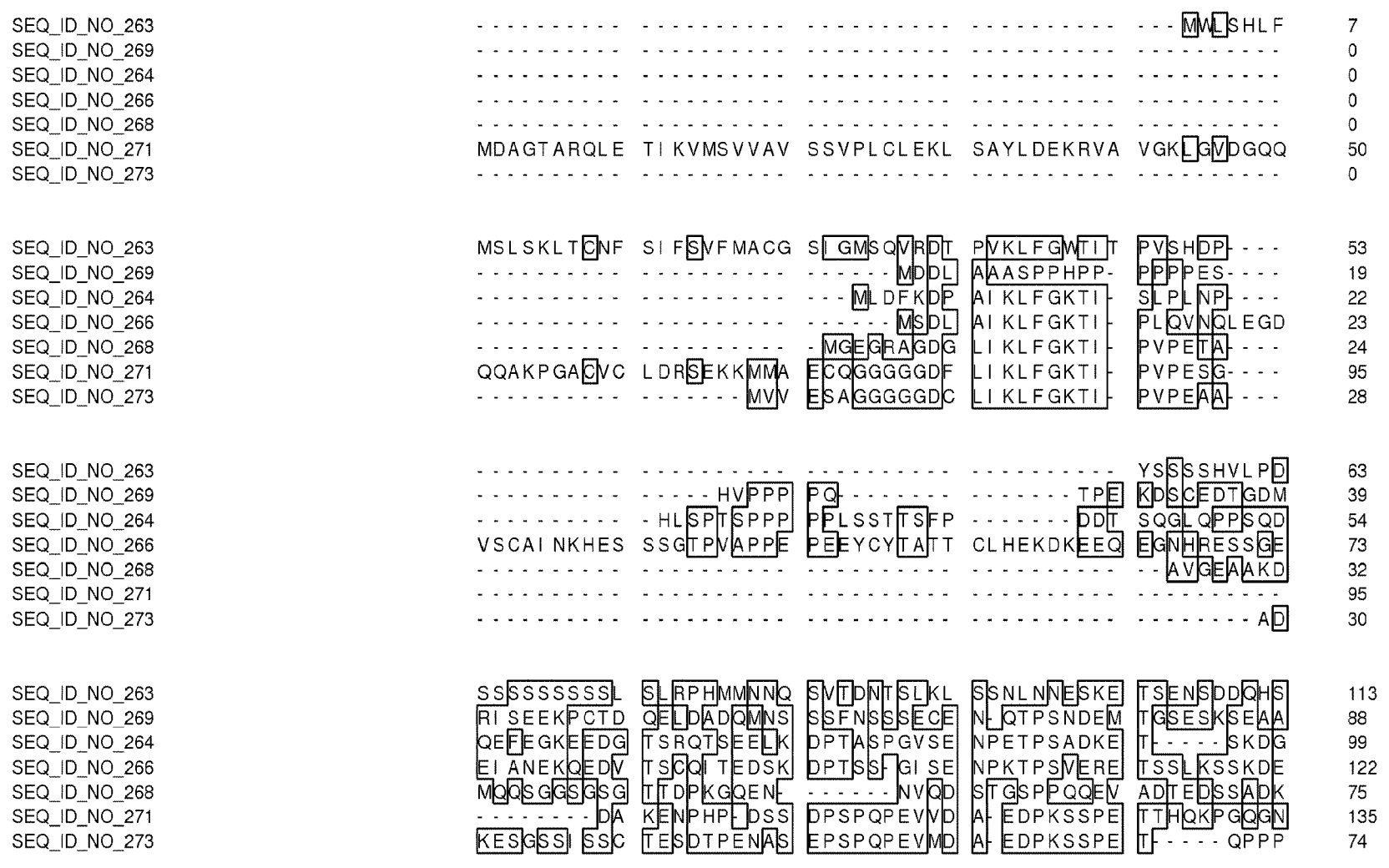
Figure 2:
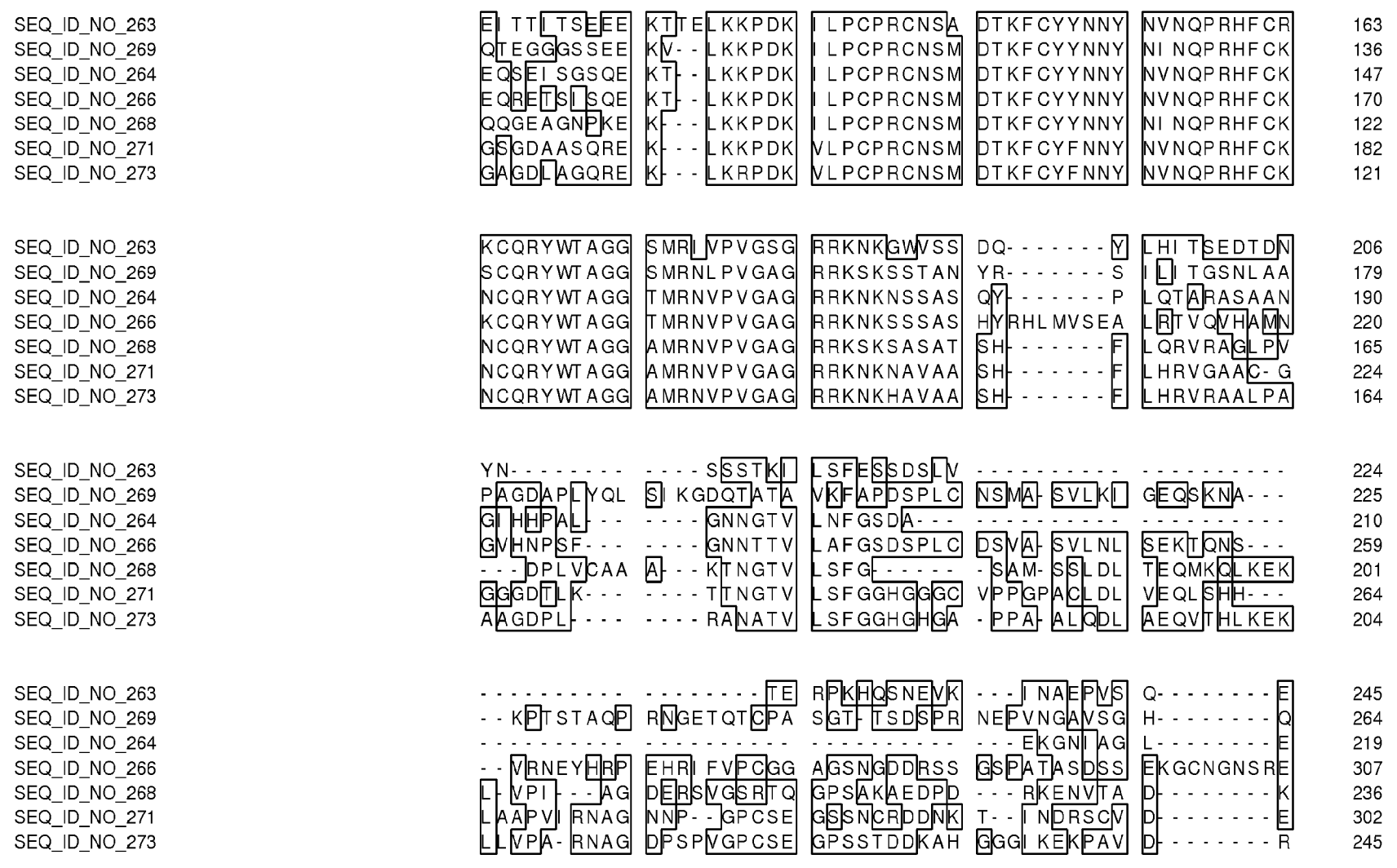
Figure 2:
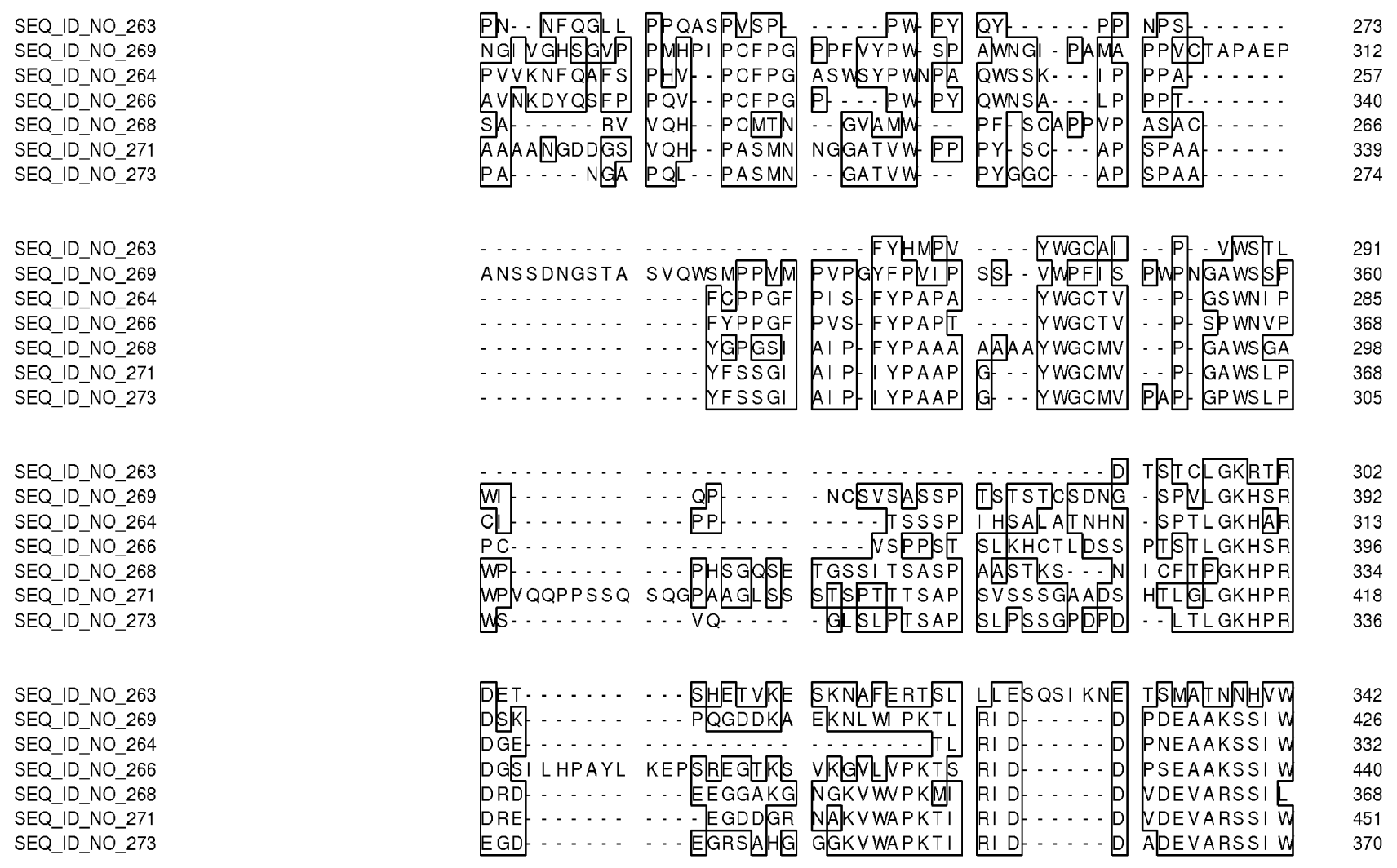

Examples of amino acid sequences of functional homologs of the polypeptide set forth in SEQ ID NO: 263 are provided in FIG. 2 and in the Sequence Listing. Such functional homologs include, for example, GI: 157355009 (SEQ ID NO: 264), CeresAnnot: 1464457 (SEQ ID NO: 266), CeresClone: 1584660 (SEQ ID NO: 268), GI: 115474149 (SEQ ID NO: 269), CeresAnnot: 8636233 (SEQ ID NO: 271), CeresClone: 1777035 (SEQ ID NO: 273), CeresClone: 1990929 (SEQ ID NO: 275), GI: 194692166 (SEQ ID NO: 276), CeresAnnot: 1458507 (SEQ ID NO: 278), GI: 147780712 (SEQ ID NO: 279), CeresAnnot: 8642924 (SEQ ID NO: 281), GI: 115451001 (SEQ ID NO: 282), AAF87041 (SEQ ID NO: 283), CeresClone: 1573856 (SEQ ID NO: 285), CeresAnnot: 1476818 (SEQ ID NO: 287), CeresAnnot: 1450024 (SEQ ID NO: 289), CeresAnnot: 1503065 (SEQ ID NO: 291), GI: 147866358 (SEQ ID NO: 292), CeresClone: 230073 (SEQ ID NO: 294), (SEQ ID NO: 295), (SEQ ID NO: 296), GI: 78708599 (SEQ ID NO: 297), GT: 15451553 (SEQ ID NO: 298), GI: 125542572 (SEQ ID NO: 299), GI: 157342426 (SEQ ID NO: 300), CeresAnnot: 538622 (SEQ ID NO: 302), CeresAnnot: 8460661 (SEQ ID NO: 304), GI: 15983797 (SEQ ID NO: 305), GI: 115435804 (SEQ ID NO: 306), CeresClone: 1599579 (SEQ ID NO: 308), CeresAnnot: 1469831 (SEQ ID NO: 310), GI: 9758342 (SEQ ID NO: 311), GI: 21536859 (SEQ ID NO: 312), CeresClone: 113639 (SEQ ID NO: 314), GI: 15232818 (SEQ ID NO: 315), CeresClone: 1571328 (SEQ ID NO: 317), CeresClone: 1868988 (SEQ ID NO: 319), GI: 1669341 (SEQ ID NO: 320), or GI: 157359317 (SEQ ID NO: 321). In some cases, a functional homolog of SEQ ID NO: 263 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 263.

Figure 3:
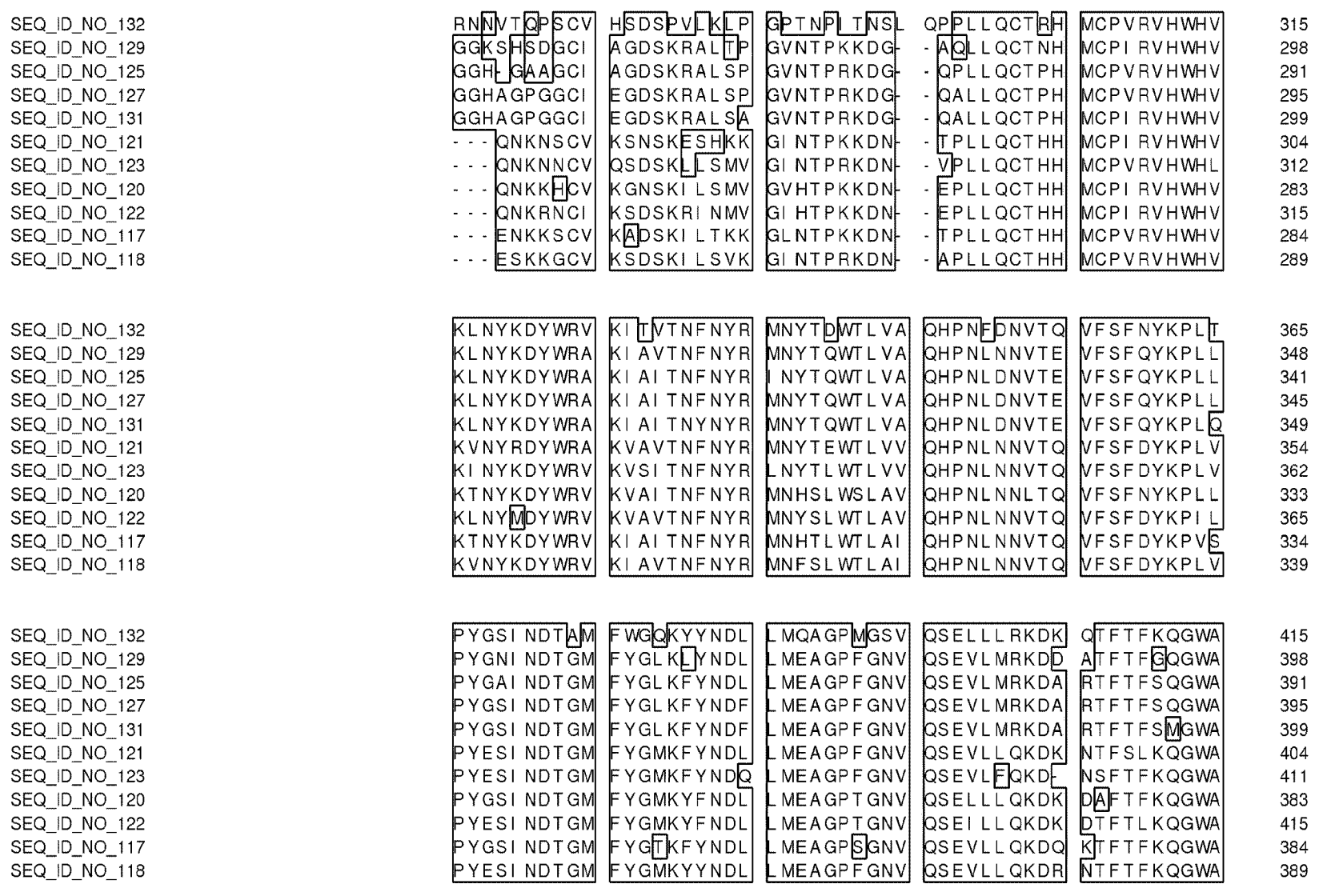

Examples of amino acid sequences of functional homologs of the polypeptide set forth in SEQ ID NO: 117 are provided in FIG. 3 and in the Sequence Listing. Such functional homologs include, for example, GI: 90657534 (SEQ ID NO: 118), CeresClone: 1237946 (SEQ ID NO: 120), GI: 118488472 (SEQ ID NO: 121), GI: 38194917 (SEQ ID NO: 122), GI: 157341292 (SEQ ID NO: 123), CeresClone: 1957107 (SEQ ID NO: 125), CeresAnnot: 8640603 (SEQ ID NO: 127), CeresClone: 829440 (SEQ ID NO: 129), CeresClone: 285169 (SEQ ID NO: 131), GI: 116790012 (SEQ ID NO: 132), GI: 157356290 (SEQ ID NO: 133), CeresAnnot: 1450186 (SEQ ID NO: 135), CeresClone: 1804732 (SEQ ID NO: 137), CeresClone: 1781794 (SEQ ID NO: 139), CeresAnnot: 8656625 (SEQ ID NO: 141), GI: 162462515 (SEQ ID NO: 142), CeresClone: 570485 (SEQ ID NO: 144), GI: 125586664 (SEQ ID NO: 145), GI: 116788824 (SEQ ID NO: 146), GI: 115453531 (SEQ ID NO: 147), CeresClone: 17250 (SEQ ID NO: 149), CeresAnnot: 1363625 (SEQ ID NO: 151), GI: 75133694 (SEQ ID NO: 152), GI: 147780878 (SEQ ID NO: 153), GI: 157341291 (SEQ ID NO: 154), GI: 38194916 (SEQ ID NO: 155), GI: 157356291 (SEQ ID NO: 156), CeresClone: 1883580 (SEQ ID NO: 158), CeresClone: 1848658 (SEQ ID NO: 160), CeresAnnot: 1450185 (SEQ ID NO: 162), GI: 13477083 (SEQ ID NO: 163), GI: 115463639 (SEQ ID NO: 164), CeresClone: 98007 (SEQ ID NO: 166), CeresAnnot: 1326475 (SEQ ID NO: 168), GI: 115473243 (SEQ ID NO: 169), CeresAnnot: 870466 (SEQ ID NO: 171), CeresClone: 1806851 (SEQ ID NO: 173), GI: 75133695 (SEQ ID NO: 174), CeresClone: 1788775 (SEQ ID NO: 176), CeresClone: 1546455 (SEQ ID NO: 178), CeresClone: 1902642 (SEQ ID NO: 180), CeresAnnot: 8632643 (SEQ ID NO: 182), CeresClone: 236876 (SEQ ID NO: 184), GI: 90657629 (SEQ ID NO: 185), GI: 30090032 (SEQ ID NO: 186), CeresAnnot: 8640602 (SEQ ID NO: 188), GI: 115453533 (SEQ ID NO: 189), GI: 162462330 (SEQ ID NO: 190), GI: 38230578 (SEQ ID NO: 191), CeresAnnot: 8632641 (SEQ ID NO: 193), GI: 168016456 (SEQ ID NO: 194), GI: 125532513 (SEQ ID NO: 195), GI: 157354382 (SEQ ID NO: 196), CeresAnnot: 1481980 (SEQ ID NO: 198), CeresAnnot: 1535466 (SEQ ID NO: 200), CeresAnnot: 1297618 (SEQ ID NO: 202), GI: 119040466 (SEQ ID NO: 203), GI: 116310381 (SEQ ID NO: 204), CeresAnnot: 8702104 (SEQ ID NO: 206), or GI: 157340500 (SEQ ID NO: 207). In some cases, a functional homolog of SEQ ID NO: 117 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 117.

Figure 4:
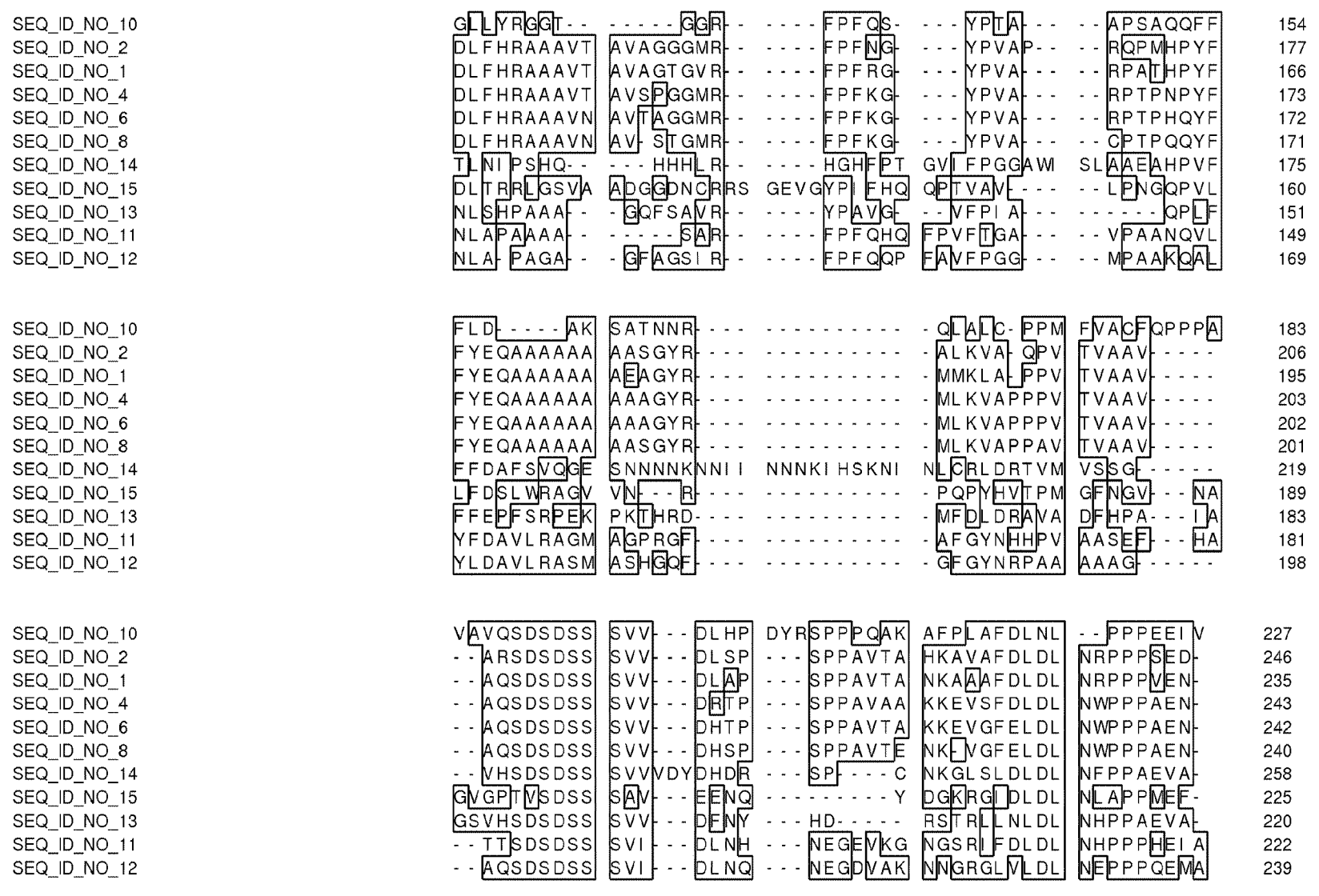

Examples of amino acid sequences of functional homologs of the polypeptide set forth in SEQ ID NO: 1 are provided in FIG. 4 and in the Sequence Listing. Such functional homologs include, for example, GI: 84795244 (SEQ ID NO: 2), CeresClone: 1725396 (SEQ ID NO: 4), CeresAnnot: 8669118 (SEQ ID NO: 6), CeresClone: 280241 (SEQ ID NO: 8), CeresClone: 1712594 (SEQ ID NO: 10), GI: 190361125 (SEQ ID NO: 11), GI: 4099921 (SEQ ID NO: 12), GI: 147844573 (SEQ ID NO: 13), GI: 67906426 (SEQ ID NO: 14), GI: 57012757 (SEQ ID NO: 15), GI: 56567583 (SEQ ID NO: 16), GI: 84795246 (SEQ ID NO: 17), GI: 84795248 (SEQ ID NO: 18), CeresClone: 1805203 (SEQ ID NO: 20), CeresClone: 101497672 (SEQ ID NO: 22), CeresClone: 224845 (SEQ ID NO: 24), GI: 115464685 (SEQ ID NO: 25), CeresClone: 1287030 (SEQ ID NO: 27), CeresAnnot: 8733383 (SEQ ID NO: 29), GI: 84795240 (SEQ ID NO: 30), CeresClone: 1806017 (SEQ ID NO: 32), GI: 84795242 (SEQ ID NO: 33), GI: 84795238 (SEQ ID NO: 34), CeresClone: 1733772 (SEQ ID NO: 36), GI: 37625037 (SEQ ID NO: 37), GI: 37625035 (SEQ ID NO: 38), GI: 147805535 (SEQ ID NO: 39), GI: 157358724 (SEQ ID NO: 40), GI: 4099914 (SEQ ID NO: 41), CeresAnnot: 1520029 (SEQ ID NO: 43), CeresClone: 1065091 (SEQ ID NO: 45), CeresClone: 1793792 (SEQ ID NO: 47), CeresClone: 1619220 (SEQ ID NO: 49), GI: 57012875 (SEQ ID NO: 50), GI: 147811787 (SEQ ID NO: 51), CeresClone: 1842925 (SEQ ID NO: 53), GI: 20340233 (SEQ ID NO: 54), CeresClone: 1657843 (SEQ ID NO: 56), CeresAnnot: 1455887 (SEQ ID NO: 58), GI: 118490009 (SEQ ID NO: 59), CeresClone: 1381515 (SEQ ID NO: 61), CeresClone: 22775 (SEQ ID NO: 63), GI: 60459377 (SEQ ID NO: 64), CeresAnnot: 1488231 (SEQ ID NO: 66), CeresClone: 1884969 (SEQ ID NO: 68), CeresClone: 1802100 (SEQ ID NO: 70), GI: 156145802 (SEQ ID NO: 71), GI: 28274832 (SEQ ID NO: 72), CeresClone: 568399 (SEQ ID NO: 74), or GI: 115460458 (SEQ ID NO: 75). In some cases, a functional homolog of SEQ ID NO: 1 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1.

Figure 5:
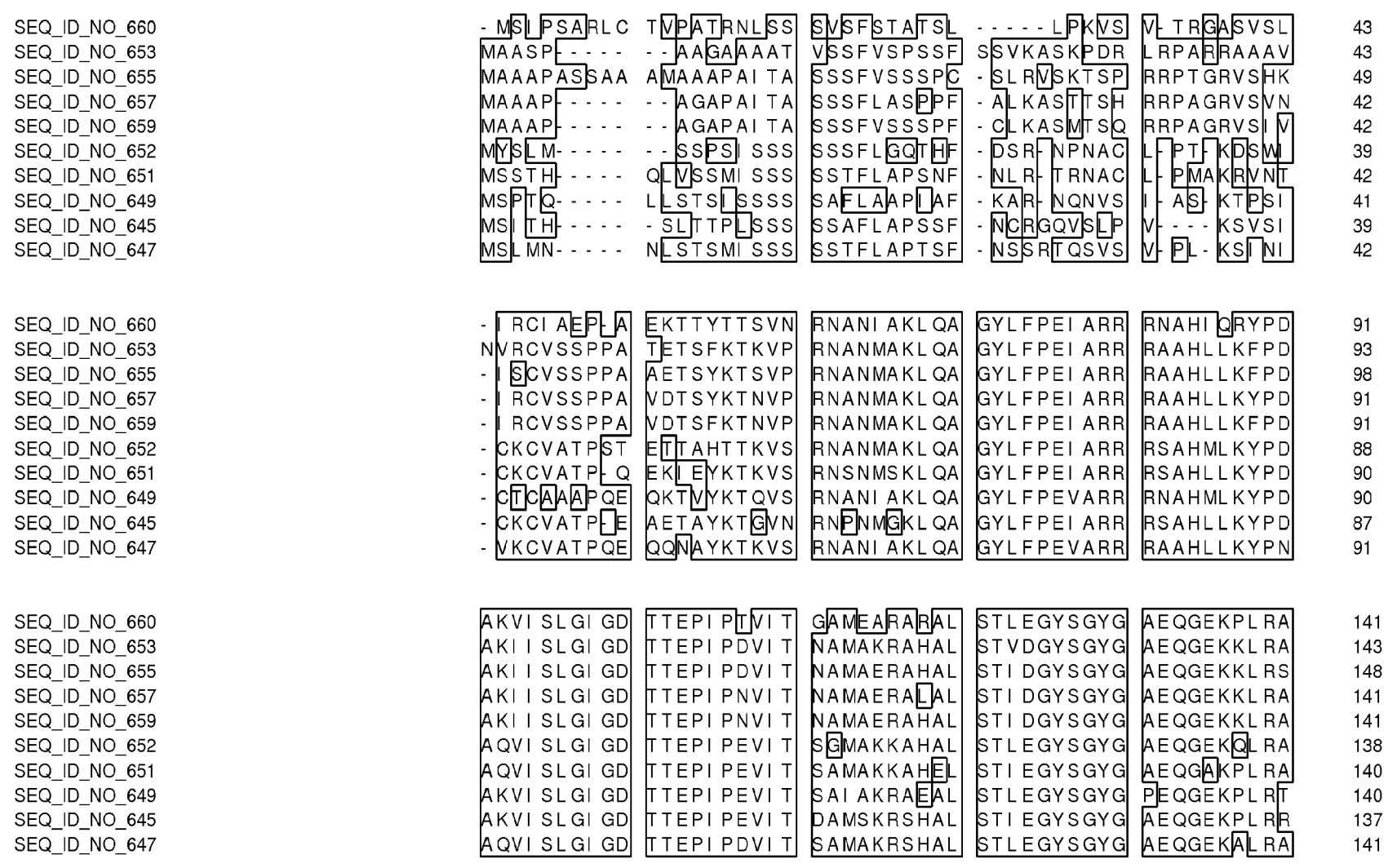
Figure 5:
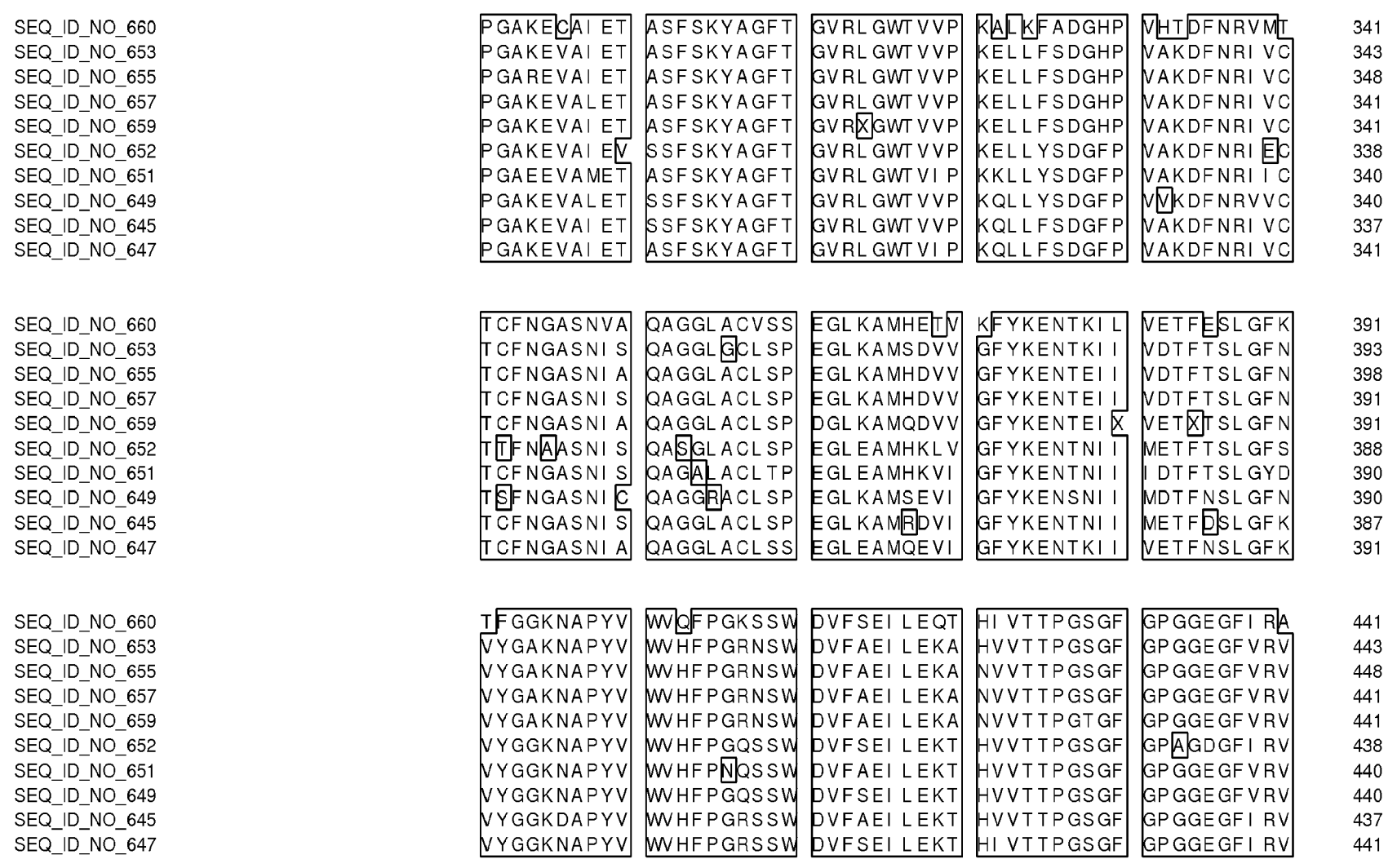

Examples of amino acid sequences of functional homologs of the polypeptide set forth in SEQ ID NO: 645 are provided in FIG. 5 and in the Sequence Listing. Such functional homologs include, for example CeresClone: 1925947 (SEQ ID NO: 647), CeresAnnot: 1514501 (SEQ ID NO: 649), CeresAnnot: 849672 (SEQ ID NO: 651), GI: 157355942 (SEQ ID NO: 652), GI: 115452503 (SEQ ID NO: 653), CeresClone: 1790933 (SEQ ID NO: 655), CeresAnnot: 8641620 (SEQ ID NO: 657), CeresClone: 281497 (SEQ ID NO: 659), GI: 168013851 (SEQ ID NO: 660), CeresClone: 143214 (SEQ ID NO: 662), CeresClone: 1781022 (SEQ ID NO: 664), CeresClone: 618639 (SEQ ID NO: 666), GI:118483001 (SEQ ID NO: 667), CeresClone: 38404 (SEQ ID NO: 669), GI: 3549670 (SEQ ID NO: 670), GI: 37703720 (SEQ ID NO: 671), GI: 152149571 (SEQ ID NO: 672), GI: 125603687 (SEQ ID NO: 673), GI: 108707679 (SEQ ID NO: 674), GI: 157352390 (SEQ ID NO: 675), GI: 159469820 (SEQ ID NO: 676), GI: 145344081 (SEQ ID NO: 677), or Ceres Annot ID no. 1461228 (SEQ ID NO: 689). In some cases, a functional homolog of SEQ ID NO: 645 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 645.

Examples of amino acid sequences of functional homologs of the polypeptide set forth in SEQ ID NO: 253 are provided in FIG. 6 and in the Sequence Listing. Such functional homologs include, for example, CeresClone: 951785 (SEQ ID NO: 255), CeresAnnot: 1440346 (SEQ ID NO: 257), CeresClone: 1085177 (SEQ ID NO: 259), or CeresClone: 157151 (SEQ ID NO: 261). In some cases, a functional homolog of SEQ ID NO: 253 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 253.

Figure 7:
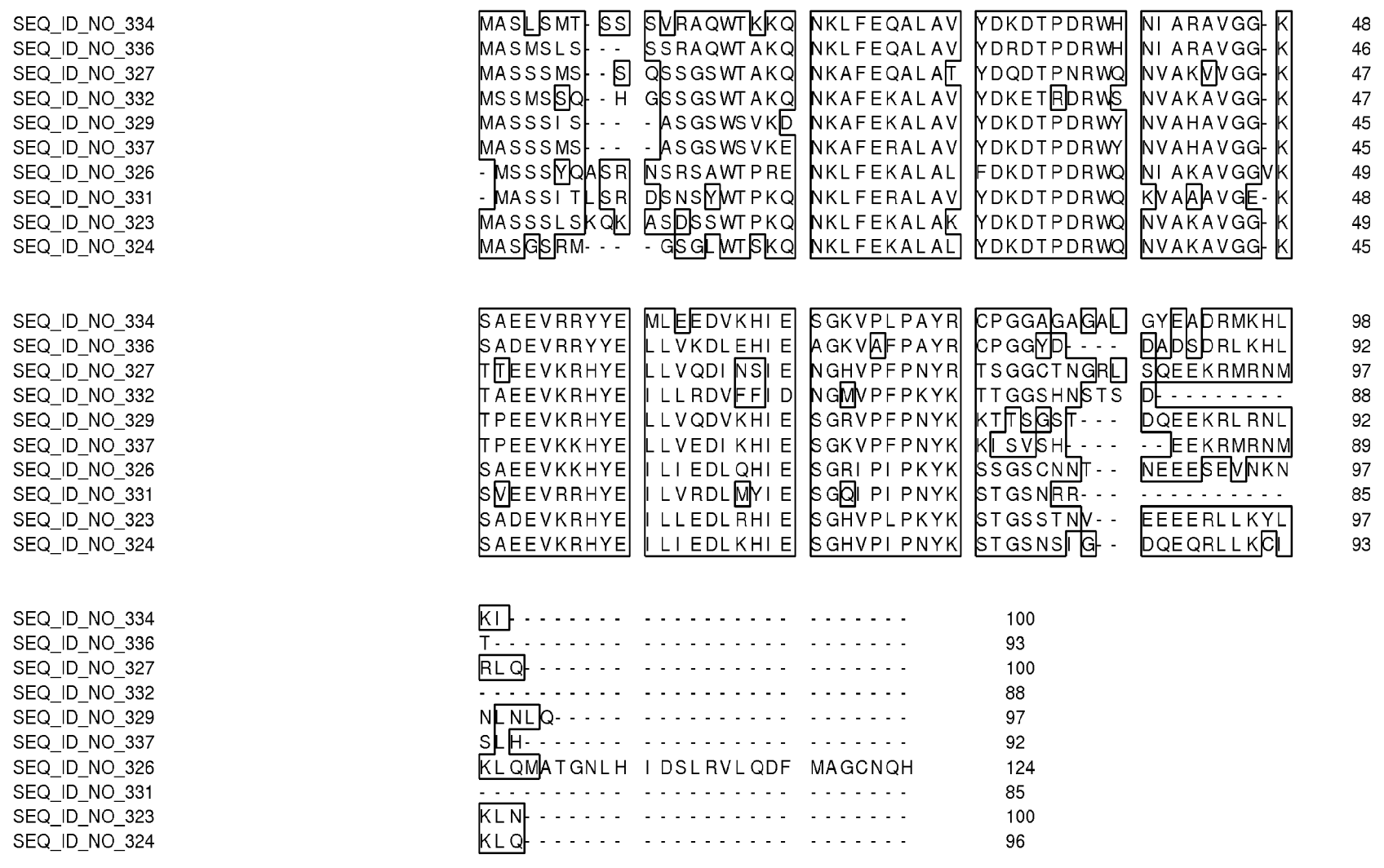

Examples of amino acid sequences of functional homologs of the polypeptide set forth in SEQ ID NO: 323 are provided in FIG. 7 and in the Sequence Listing. Such functional homologs include, for example, GI: 157340812 (SEQ ID NO: 324), CeresAnnot: 1460824 (SEQ ID NO: 326), GI: 145356202 (SEQ ID NO: 327), CeresClone: 477814 (SEQ ID NO: 329), CeresClone: 1914387 (SEQ ID NO: 331), GI: 7981380 (SEQ ID NO: 332), CeresClone: 1910072 (SEQ ID NO: 334), CeresClone: 331755 (SEQ ID NO: 336), GI: 124360540 (SEQ ID NO: 337), GI: 157335318 (SEQ ID NO: 338), CeresAnnot: 1503394 (SEQ ID NO: 340), CeresAnnot: 1442707 (SEQ ID NO: 342), GI: 147784500 (SEQ ID NO: 343), CeresAnnot: 1514100 (SEQ ID NO: 345), CeresAnnot: 850366 (SEQ ID NO: 347), CeresAnnot: 543794 (SEQ ID NO: 349), CeresAnnot: 1495620 (SEQ ID NO: 351), CeresClone: 1653552 (SEQ ID NO: 353), GI: 147767321 (SEQ ID NO: 354), CeresAnnot: 1510450 (SEQ ID NO: 356), GI: 110931736 (SEQ ID NO: 357), CeresClone: 1916884 (SEQ ID NO: 359), CeresClone: 1847251 (SEQ ID NO: 361), CeresAnnot: 1457249 (SEQ ID NO: 363), CeresClone: 1113584 (SEQ ID NO: 365), CeresClone: 1927753 (SEQ ID NO: 367), CeresClone: 857342 (SEQ ID NO: 369), CeresClonc: 100068619 (SEQ ID NO: 371), GI: 145327247 (SEQ ID NO: 372), CeresAnnot: 8461532 (SEQ ID NO: 374), CeresClone: 1722230 (SEQ ID NO: 376), CeresClone: 1897493 (SEQ ID NO: 378), CeresAnnot: 838426 (SEQ ID NO: 380), CeresAnnot: 827713 (SEQ ID NO: 382), CeresClone: 1763593 (SEQ ID NO: 384), CeresClone: 143475 (SEQ ID NO: 386), CeresAnnot: 8456508 (SEQ ID NO: 388), CeresClone: 100002959 (SEQ ID NO: 390), GI: 118137433 (SEQ ID NO: 391), CeresClone: 1523182 (SEQ ID NO: 393), CeresClone: 1761808 (SEQ ID NO: 395), CeresClone: 1069222 (SEQ ID NO: 397), CeresAnnot: 8734209 (SEQ ID NO: 399), CeresAnnot: 8461540 (SEQ ID NO: 401), CeresClone: 1086604 (SEQ ID NO: 403), CeresClone: 41695 (SEQ ID NO: 405), GI: 112292440 (SEQ ID NO: 406), GI: 116830269 (SEQ ID NO: 407), CeresClone: 1775942 (SEQ ID NO: 409), CeresClone: 1723374 (SEQ ID NO: 411), CeresAnnot: 1457230 (SEQ ID NO: 413), CeresAnnot: 8667653 (SEQ ID NO: 415), GI: 115465643 (SEQ ID NO: 416), GI: 5091605 (SEQ ID NO: 417), GI: 125553458 (SEQ ID NO: 418), CeresAnnot: 1510435 (SEQ ID NO: 420), GI: 115438765 (SEQ ID NO: 421), GI: 112292438 (SEQ ID NO: 422), or CeresAnnot: 1770841 (SEQ ID NO: 424). In some cases, a functional homolog of SEQ ID NO: 323 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 323.

Examples of amino acid sequences of functional homologs of the polypeptide set forth in SEQ ID NO: 595 are provided in FIG. 8 and in the Sequence Listing. Such functional homologs include, for example, CeresClone: 644331 (SEQ ID NO: 597), GI: 15227859 (SEQ ID NO: 598), CeresAnnot: 1504349 (SEQ ID NO: 600), CeresAnnot: 1265088 (SEQ ID NO: 602), (SEQ ID NO: 603), GI: 125527987 (SEQ ID NO: 604), GI: 14279437 (SEQ ID NO: 605), ES902065 (SEQ ID NO: 606), CeresClone: 1065042 (SEQ ID NO: 608), GI: 157329790 (SEQ ID NO: 609), GI: 15227861 (SEQ ID NO: 610), GI: 146272407 (SEQ ID NO: 611), CeresClone: 95094 (SEQ ID NO: 613), CeresClone: 1714893 (SEQ ID NO: 615), GI: 157329890 (SEQ ID NO: 616), CeresAnnot: 859635 (SEQ ID NO: 618), GI: 115440397 (SEQ ID NO: 619), GI: 40549303 (SEQ ID NO: 620), CeresAnnot: 1457048 (SEQ ID NO: 622), GI: 50401192 (SEQ ID NO: 623), CeresAnnot: 1451281 (SEQ ID NO: 625), CeresAnnot: 1510252 (SEQ ID NO: 627), CeresClone: 1822691 (SEQ ID NO: 629), GI: 197312921 (SEQ ID NO: 630), CeresAnnot: 8456439 (SEQ ID NO: 632), EX096388 (SEQ ID NO: 633), GI: 15028131 (SEQ ID NO: 634), CeresClone: 270875 (SEQ ID NO: 636), GI: 27754457 (SEQ ID NO: 637), GI: 16648679 (SEQ ID NO: 638), GI: 15227863 (SEQ ID NO: 639), CeresAnnot: 1451282 (SEQ ID NO: 641), GI: 53830670 (SEQ ID NO: 642), GI: 146272405 (SEQ ID NO: 643), or CeresAnnot: 827940 (SEQ ID NO: 691). In some cases, a functional homolog of SEQ ID NO: 595 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 595.

Examples of amino acid sequences of functional homologs of the polypeptide set forth in SEQ ID NO: 77 are provided in FIG. 9 and in the Sequence Listing. Such functional homologs include, for example, CeresClone: 1387948 (SEQ ID NO: 79), CeresClone: 1937714 (SEQ ID NO: 81), GI: 157345132 (SEQ ID NO: 82), CeresClone: 464828 (SEQ ID NO: 84), CeresAnnot: 1451368 (SEQ ID NO: 86), GI: 37695575 (SEQ ID NO: 87), GI: 116790033 (SEQ ID NO: 88), CeresClone: 1346042 (SEQ ID NO: 90), CeresClone: 1118610 (SEQ ID NO: 92), CeresClone: 982000 (SEQ ID NO: 94), CeresClone: 959670 (SEQ ID NO: 96), CeresClone: 952522 (SEQ ID NO: 98), CeresClone: 1914539 (SEQ ID NO: 100), CeresClone: 668581 (SEQ ID NO: 102), CeresClone: 1914939 (SEQ ID NO: 104), CeresClone: 723694 (SEQ ID NO: 106), CeresAnnot:

1456949 (SEQ ID NO: 108), CeresAnnot: 1539918 (SEQ ID NO: 110), CeresAnnot: 8456138 (SEQ ID NO: 112), CeresAnnot: 1486506 (SEQ ID NO: 114), or GI: 116786293 (SEQ ID NO: 115). In some cases, a functional homolog of SEQ ID NO: 77 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 77.

Figure 10:
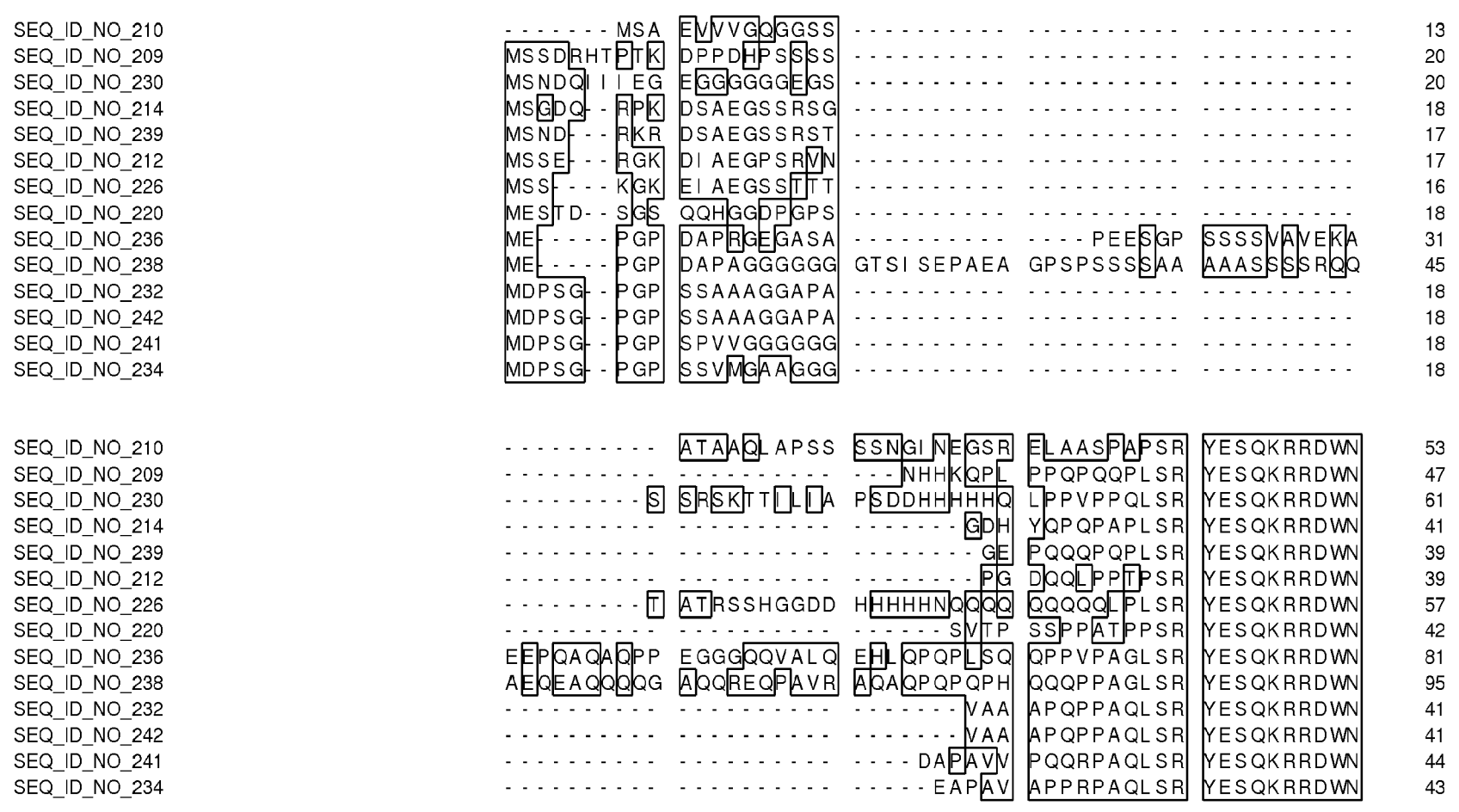
Figure 10:
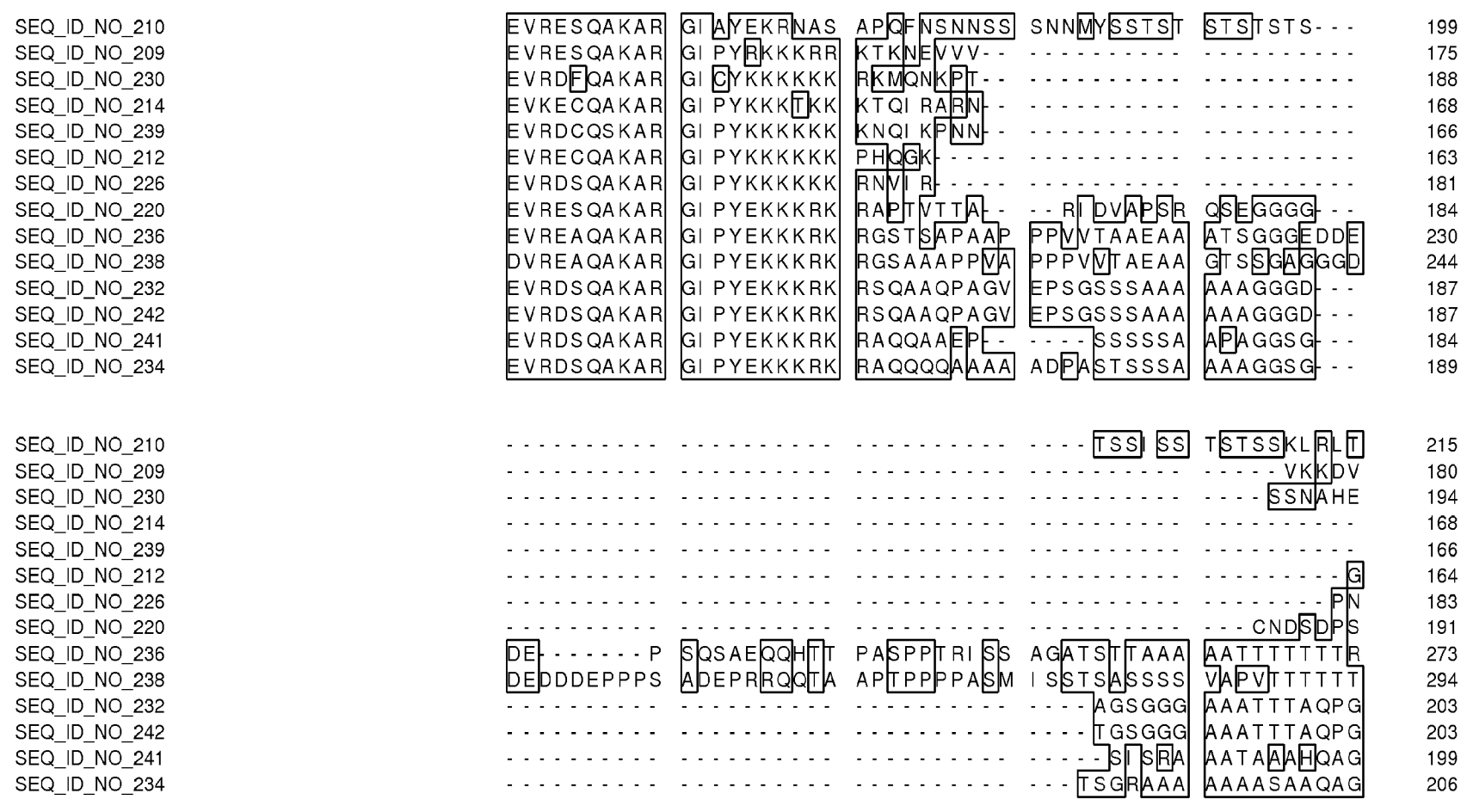

Examples of amino acid sequences of functional homologs of the polypeptide set forth in SEQ ID NO: 209 are provided in FIG. 10 and in the Sequence Listing. Such functional homologs include, for example, GI: 116780542 (SEQ ID NO: 210), CeresClone: 1848017 (SEQ ID NO: 212), CeresAnnot: 1466494 (SEQ ID NO: 214), CeresAnnot: 1449022 (SEQ ID NO: 216), CeresAnnot: 1482911 (SEQ ID NO: 218), CeresClone: 1118987 (SEQ ID NO: 220), CeresClone: 1073674 (SEQ ID NO: 222), CeresClone: 1084747 (SEQ ID NO: 224), CeresClone: 536345 (SEQ ID NO: 226), CeresClone: 1650005 (SEQ ID NO: 228), CeresAnnot: 8453882 (SEQ ID NO: 230), CeresAnnot: 1373087 (SEQ ID NO: 232), CeresAnnot: 8669372 (SEQ ID NO: 234), CeresClone: 1048839 (SEQ ID NO: 236), CeresClone: 281322 (SEQ ID NO: 238), GI: 147795605 (SEQ ID NO: 239), CeresClone: 2004419 (SEQ ID NO: 241), GI: 125543059 (SEQ ID NO: 242), AT1G16910_LSH8 (SEQ ID NO: 243), AT1G78815_LSH7 (SEQ ID NO: 244), AT2G31160_LSH3 (SEQ ID NO: 245), AT2G42610_LSH10 (SEQ ID NO: 246), AT3G04510_LSH2 (SEQ ID NO: 247), AT3G23290_LSH4 (SEQ ID NO: 248), AT5G28490_LSH1 (SEQ ID NO: 249), AT5G58500_LSH5 (SEQ ID NO: 250), or At1g07090_LSH6 (SEQ ID NO: 251). In some cases, a functional homolog of SEQ ID NO: 209 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 209.

Figure 11:
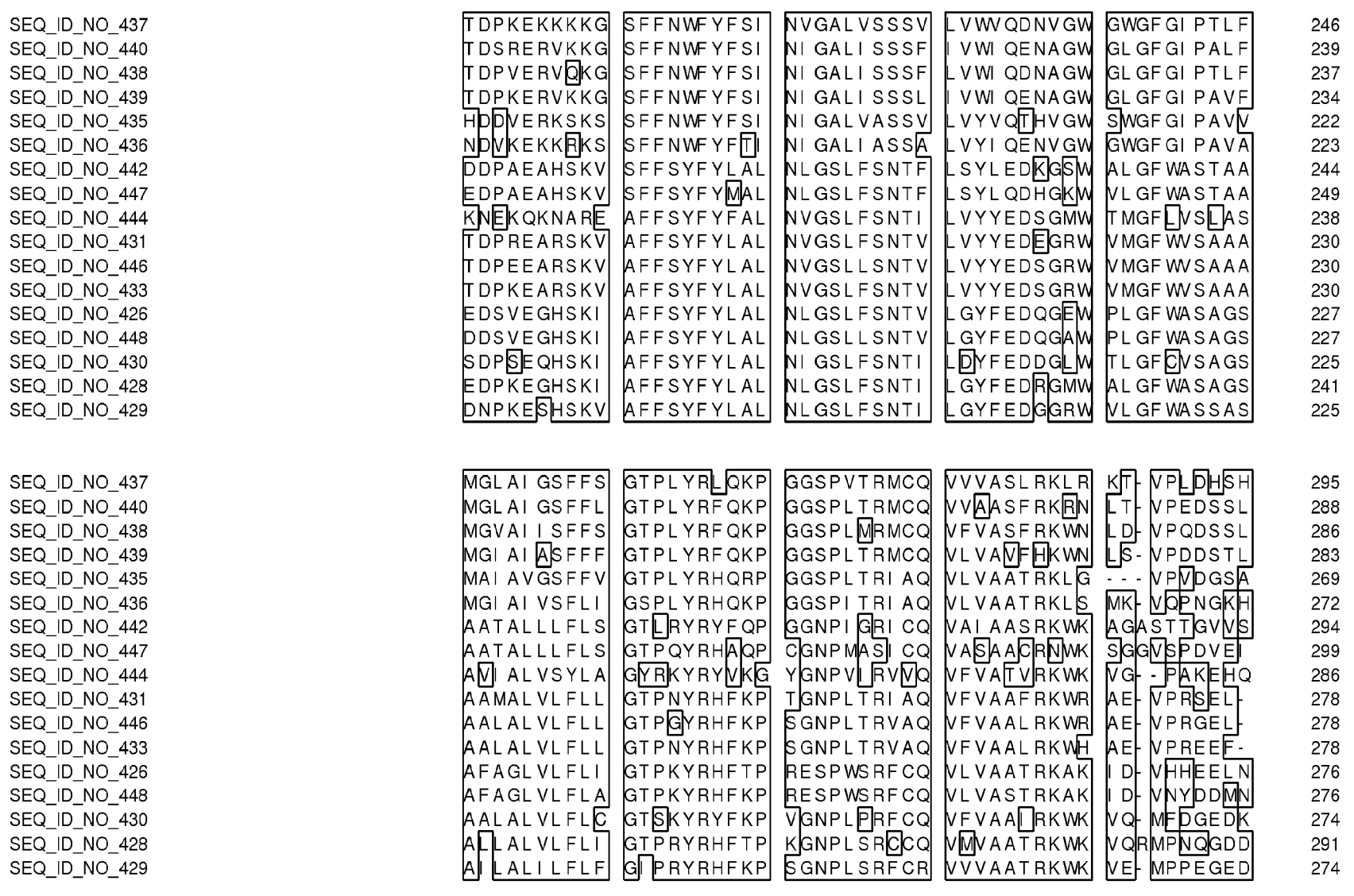
Figure 11:
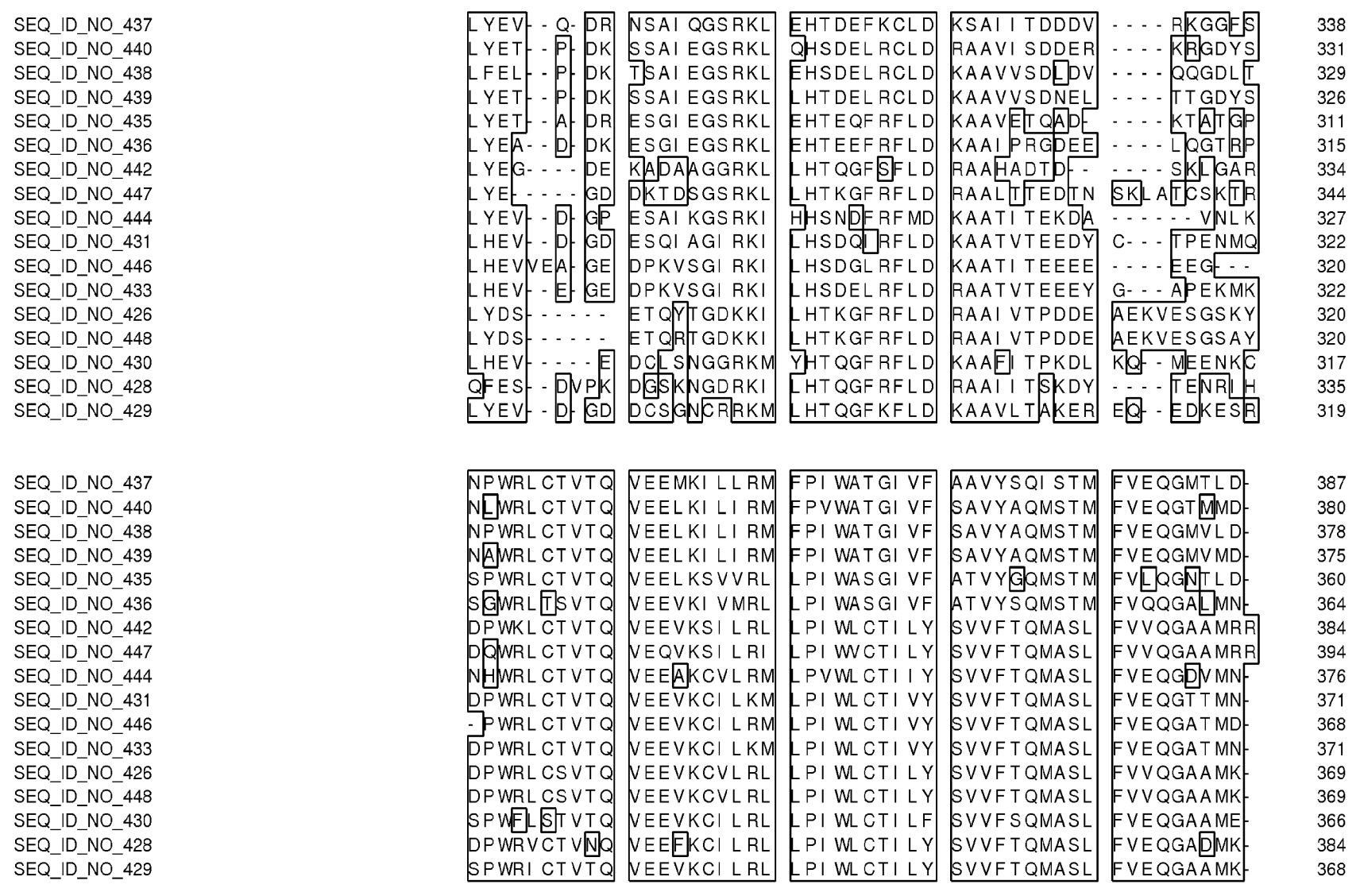
Figure 11:
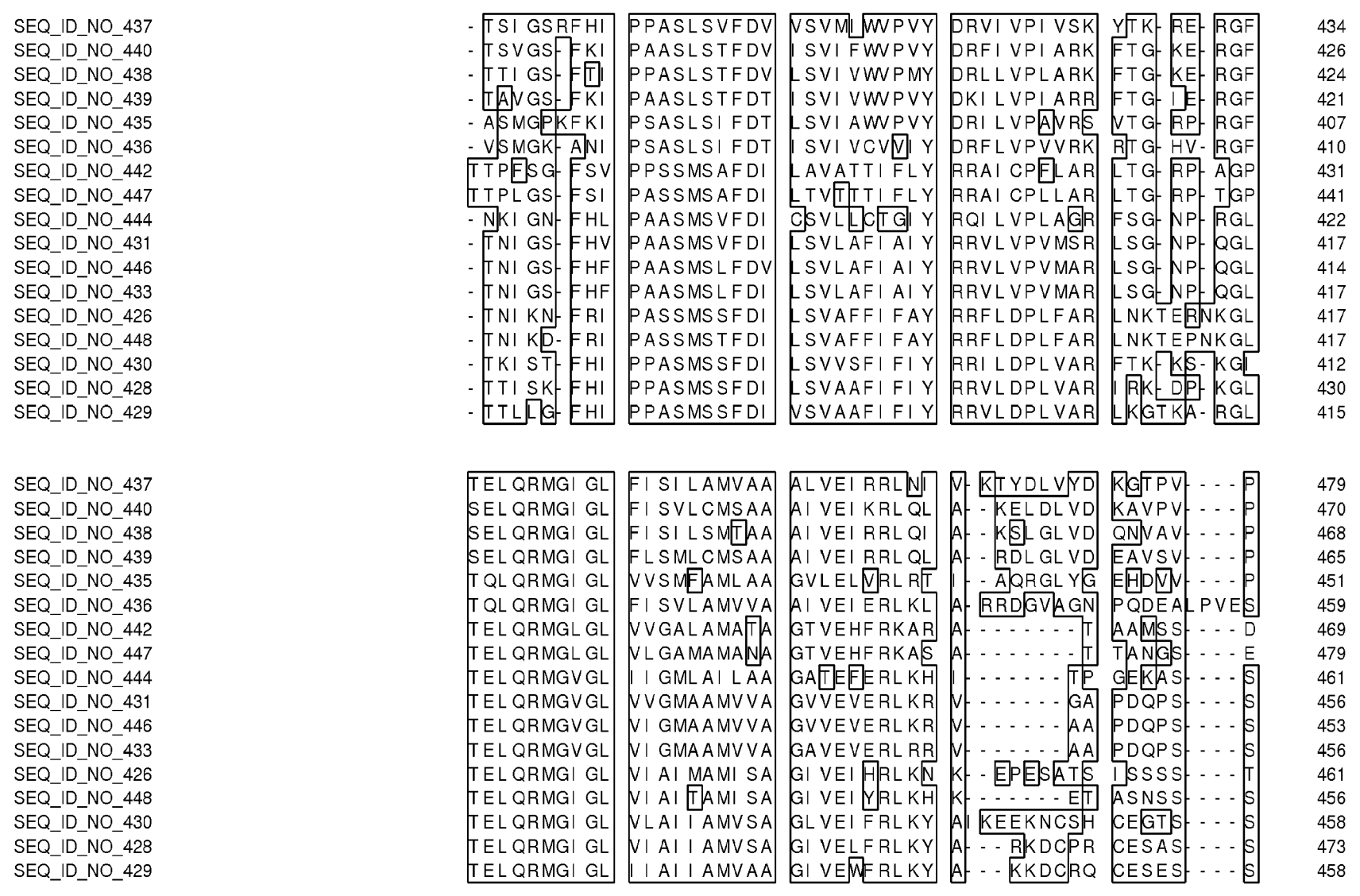

Examples of amino acid sequences of functional homologs of the polypeptide set forth in SEQ ID NO: 426 are provided in FIG. 11 and in the Sequence Listing. Such functional homologs include, for example, CeresAnnot: 1472338_Pb (SEQ ID NO: 428), GI: 157344683_Vv (SEQ ID NO: 429), GI: 87240677_Mt (SEQ ID NO: 430), GI:115448297_Os (SEQ ID NO: 431), CeresClone: 1844568_Pv (SEQ ID NO: 433), CeresClone: 797829_Tm (SEQ ID NO: 435), GI: 168033816_Pp (SEQ ID NO: 436), GI: 116788004_Ps (SEQ ID NO: 437), GI: 149900503_Ha (SEQ ID NO: 438), GI: 4102839_S1 (SEQ ID NO: 439), GI: 31088360_Vf (SEQ ID NO: 440), CeresAnnot: 8681236_Sb (SEQ ID NO: 442), CeresAnnot: 8519531 Gm (SEQ ID NO: 444), CeresAnnot: 8631372_Zm (SEQ ID NO: 446), GI: 151426449_Hv (SEQ ID NO: 447), GI: 192757675_Br (SEQ ID NO: 448), GI: 2655098 (SEQ ID NO: 449), GI: 194690746 (SEQ ID NO: 450), CeresClone: 752925 (SEQ ID NO: 452), GI: 125540898 (SEQ ID NO: 453), GI: 26451333 (SEQ ID NO: 454), GI: 2160144 (SEQ ID NO: 455), GI: 30696666 (SEQ ID NO: 456), GI: 125556922 (SEQ ID NO: 457), CeresAnnot: 1529287 (SEQ ID NO: 459), CeresClone: 1806748 (SEQ ID NO: 461), CeresAnnot: 8755095 (SEQ ID NO: 463), GI: 147827175 (SEQ ID NO: 464), CeresClone: 1888865 (SEQ ID NO: 466), GI: 157337163 (SEQ ID NO: 467), GI: 115434472 (SEQ ID NO: 468), CeresAnnot: 6252512 (SEQ ID NO: 470), CeresAnnot: 1569074 Mt (SEQ ID NO: 472), CeresAnnot: 1475845 (SEQ ID NO: 474), CeresAnnot: 1501483 (SEQ ID NO: 476), CeresAnnot: 8755079 (SEQ ID NO: 478), GI: 115470147 (SEQ ID NO: 479), GI: 15240905 (SEQ ID NO: 480), CeresAnnot: 8755085 (SEQ ID NO: 482), GI: 147853446 (SEQ ID NO: 483), GI: 157346087 (SEQ ID NO: 484), CeresAnnot: 1538867 (SEQ ID NO: 486), CeresAnnot: 8755091 (SEQ ID NO: 488), CeresAnnot: 1492702 (SEQ ID NO: 490), CeresClone: 325604 (SEQ ID NO: 492), GI: 108707040 (SEQ ID NO: 493), CeresAnnot: 1302517_At (SEQ ID NO: 495), CeresAnnot: 1355964 (SEQ ID NO: 497), CeresAnnot: 8755104 (SEQ ID NO: 499), GI: 147802380 (SEQ ID NO: 500), GI: 510238 (SEQ ID NO: 501), GI: 157341962 (SEQ ID NO: 502), GI: 6635838 (SEQ ID NO: 503), GI: 4455276 (SEQ ID NO: 504), CeresAnnot: 8642246 (SEQ ID NO: 506), CeresAnnot: 8633032 (SEQ ID NO: 508), GI: 157337654 (SEQ ID NO: 509), CeresAnnot: 8642241 (SEQ ID NO: 511), CeresAnnot: 1520085 (SEQ ID NO: 513), CeresAnnot: 1514979 (SEQ ID NO: 515), GI: 147858202 (SEQ ID NO: 516), GI: 125545538 (SEQ ID NO: 517), GI: 115451771 (SEQ ID NO: 518), GI: 125587732 (SEQ ID NO: 519), CeresAnnot: 1516968 (SEQ ID NO: 521), CeresClone: 350844 (SEQ ID NO: 523), CeresAnnot: 8658700 (SEQ ID NO: 525), GI: 157346088 (SEQ ID NO: 526), CeresClone: 1926916 (SEQ ID NO: 528), GI: 15226861 (SEQ ID NO: 529), CeresClone: 816960 (SEQ ID NO: 531), GI: 15232435 (SEQ ID NO: 532), CeresAnnot: 8643789 (SEQ ID NO: 534), CeresAnnot: 8631367 (SEQ ID NO: 536), GI: 157339093 (SEQ ID NO: 537), CeresAnnot: 8633031 (SEQ ID NO: 539), GI: 125543029 (SEQ ID NO: 540), GI: 115454995 (SEQ ID NO: 541), CeresAnnot: 8755090 (SEQ ID NO: 543), CeresAnnot: 8755097 (SEQ ID NO: 545), CeresAnnot: 8755098 (SEQ ID NO: 547), CeresAnnot: 8755099 (SEQ ID NO: 549), (SEQ ID NO: 550), (SEQ ID NO: 551), (SEQ ID NO: 552), CeresAnnot: 6086224 (SEQ ID NO: 693), CeresClone: 476769 (SEQ ID NO: 695), or CeresClone: 15650 (SEQ ID NO: 697). In some cases, a functional homolog of SEQ ID NO: 426 has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 426.

The identification of conserved regions in a biomass-modulating polypeptide facilitates production of variants of biomass-modulating polypeptides. Variants of biomass-modulating polypeptides typically have 10 or fewer conservative amino acid substitutions within the primary amino acid sequence, e.g., 7 or fewer conservative amino acid substitutions, 5 or fewer conservative amino acid substitutions, or between 1 and 5 conservative substitutions. A useful variant polypeptide can be constructed based on one of the alignments set forth in FIG. 1, FIG. 2, FIG. 3, FIG. 4, FIG. 5, FIG. 6, FIG. 7, FIG. 8, FIG. 9, FIG. 10, or FIG. 11 and/or homologs identified in the Sequence Listing. Such a polypeptide includes the conserved regions, arranged in the order depicted in the Figure from amino-terminal end to carboxy-terminal end. Such a polypeptide may also include zero, one, or more than one amino acid in positions marked by dashes. When no amino acids are present at positions marked by dashes, the length of such a polypeptide is the sum of the amino acid residues in all conserved regions. When amino acids are present at a position marked by dashes, such a polypeptide has a length that is the sum of the amino acid residues in all conserved regions and all dashes.

C. Functional Homologs Identified by HMMER

In some embodiments, useful biomass-modulating polypeptides include those that fit a Hidden Markov Model based on the polypeptides set forth in any one of FIGS. 1-11. A Hidden Markov Model (HMM) is a statistical model of a consensus sequence for a group of functional homologs. See, Durbin et al., *Biological Sequence Analysis: Probabilistic Models of Proteins and Nucleic Acids*, Cambridge University Press, Cambridge, UK (1998). An HMM is generated by the program HMMER 2.3.2 with default program parameters, using the sequences of the group of functional homologs as input. The multiple sequence alignment is generated by ProbCons (Do et al., Genome Res., 15(2): 330-40 (2005)) version 1.11 using a set of default parameters: -c, —consistency REPS of 2; -ir, —iterative-refinement REPS of 100; -pre, —pre-training REPS of 0. ProbCons is a public domain software program provided by Stanford University.

The default parameters for building an HMM (hmmbuild) are as follows: the default "architecture prior" (archpri) used by MAP architecture construction is 0.85, and the default cutoff threshold (idlevel) used to determine the effective sequence number is 0.62. HMMER 2.3.2 was released Oct. 3, 2003 under a GNU general public license, and is available from various sources on the World Wide Web such as hmmer.janelia.org; hmmer.wustl.edu; and fr.com/hmmer232/. Hmmbuild outputs the model as a text file.

The HMM for a group of functional homologs can be used to determine the likelihood that a candidate biomass-modulating polypeptide sequence is a better fit to that particular HMM than to a null HMM generated using a group of sequences that are not structurally or functionally related. The likelihood that a candidate polypeptide sequence is a better fit to an HMM than to a null HMM is indicated by the HMM bit score, a number generated when the candidate sequence is fitted to the HMM profile using the HMMER hmmsearch program. The following default parameters are used when running hmmsearch: the default E-value cutoff (E) is 10.0, the default bit score cutoff (T) is negative infinity, the default number of sequences in a database (Z) is the real number of sequences in the database, the default E-value cutoff for the per-domain ranked hit list (domE) is infinity, and the default bit score cutoff for the per-domain ranked hit list (domT) is negative infinity. A high HMM bit score indicates a greater likelihood that the candidate sequence carries out one or more of the biochemical or physiological function(s) of the polypeptides used to generate the HMM. A high HMM bit score is at least 20, and often is higher. Slight variations in the HMM bit score of a particular sequence can occur due to factors such as the order in which sequences are processed for alignment by multiple sequence alignment algorithms such as the ProbCons program. Nevertheless, such HMM bit score variation is minor.

The biomass-modulating polypeptides discussed below fit the indicated HMM with an HMM bit score greater than to 65. (e.g., greater than 70, 80, 90, 100, 120, 140, 200, 300, 500, 1000, 1500, or 2000). In some embodiments, the HMM bit score of a biomass-modulating polypeptide discussed below is about 50%, 60%, 70%, 80%, 90%, or 95% of the HMM bit score of a functional homolog provided in the Sequence Listing of this application. In some embodiments, a biomass-modulating polypeptide discussed below fits the indicated HMM with an HMM bit score greater than 210, and has a domain indicative of a biomass-modulating polypeptide. In some embodiments, a biomass-modulating polypeptide discussed below fits the indicated HMM with an HMM bit score greater than 210, and has 65% or greater sequence identity (e.g., 75%, 80%, 85%, 90%, 95%, or 100% sequence identity) to an amino acid sequence shown in any one of FIGS. 1-11.

Examples of polypeptides are shown in the sequence listing that have HMM bit scores greater than 130 when fitted to an HMM generated from the amino acid sequences set forth in FIG. 1 are identified in the Sequence Listing of this application. Such polypeptides include, for example, SEQ ID NOs: 554, 556, 558, 560, 562, 563, 565, 567, 569, 571, 573, 574, 575, 577, 579, 581, 583, 585, 587, 589, 591, or 593.

Examples of polypeptides are shown in the sequence listing that have HMM bit scores greater than 340 when fitted to an HMM generated from the amino acid sequences set forth in FIG. 2 are identified in the Sequence Listing of this application. Such polypeptides include, for example, SEQ ID NOs: 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, or 321.

Examples of polypeptides are shown in the sequence listing that have HMM bit scores greater than 530 when fitted to an HMM generated from the amino acid sequences set forth in FIG. 3 are identified in the Sequence Listing of this application. Such polypeptides include, for example, SEQ ID NOs: 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, or 207.

Examples of polypeptides are shown in the sequence listing that have HMM bit scores greater than 120 when fitted to an HMM generated from the amino acid sequences set forth in FIG. 4 are identified in the Sequence Listing of this application. Such polypeptides include, for example, SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, or 75. Examples of polypeptides are shown in the sequence listing that have HMM bit scores greater than 635 when fitted to an HMM generated from the amino acid sequences set forth in FIG. 5 are identified in the Sequence Listing of this application. Such polypeptides include, for example, SEQ ID NOs: 645, 647, 649, 651, 652, 653, 655, 657, 659, 660, 662, 664, 666, 667, 669, 670, 671, 672, 673, 674, 675, 676, 677, or 689.

Examples of polypeptides are shown in the sequence listing that have HMM bit scores greater than 65 when fitted to an HMM generated from the amino acid sequences set forth in FIG. 6 are identified in the Sequence Listing of this application. Such polypeptides include, for example, SEQ ID NOs: 255, 257, 259, or 261.

Examples of polypeptides are shown in the sequence listing that have HMM bit scores greater than 100 when fitted to an HMM generated from the amino acid sequences set forth in FIG. 7 are identified in the Sequence Listing of this application. Such polypeptides include, for example, SEQ ID NOs: 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, or 424.

Examples of polypeptides are shown in the sequence listing that have HMM bit scores greater than 480 when fitted to an HMM generated from the amino acid sequences set forth in FIG. 8 are identified in the Sequence Listing of this application. Such polypeptides include, for example, SEQ ID NOs: 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, or 691.

Examples of polypeptides are shown in the sequence listing that have HMM bit scores greater than 145 when fitted to an HMM generated from the amino acid sequences set forth in FIG. 9 are identified in the Sequence Listing of this application. Such polypeptides include, for example, SEQ ID NOs: 77, 79, 81, 82, 84, 86, 87, 88, 90, 92, 94, 96, 98, 100, 102, 104, 106, 108, 110, 112, 114, or 115.

Examples of polypeptides are shown in the sequence listing that have HMM bit scores greater than 280 when fitted to an HMM generated from the amino acid sequences set forth in FIG. 10 are identified in the Sequence Listing of this application. Such polypeptides include, for example, SEQ ID NOs: 209, 210, 212, 214, 216, 218, 220, 222, 224, 226, 228, 230, 232, 234, 236, 238, 239, 241, 242, 243, 244, 245, 246, 247, 248, 249, 250, or 251.

Examples of polypeptides are shown in the sequence listing that have HMM bit scores greater than 1000 when fitted to an HMM generated from the amino acid sequences set forth in FIG. 11 are identified in the Sequence Listing of this application. Such polypeptides include, for example, SEQ ID NOs: 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 693, 695, or 697.

D. Percent Identity

In some embodiments, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to one of the amino acid sequences set forth in SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. Polypeptides having such a percent sequence identity often have a domain indicative of a biomass-modulating polypeptide and/or have an HMM bit score that is greater than 65, as discussed above. Amino acid sequences of biomass-modulating polypeptides having at least 80% sequence identity to one of the amino acid sequences set forth in SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697 are provided in FIGS. 1-11 and in the Sequence Listing.

"Percent sequence identity" refers to the degree of sequence identity between any given reference sequence, e.g., SEQ ID NO: 1, and a candidate biomass-modulating sequence. A candidate sequence typically has a length that is from 80 percent to 200 percent of the length of the reference sequence, e.g., 82, 85, 87, 89, 90, 93, 95, 97, 99, 100, 105, 110, 115, 120, 130, 140, 150, 160, 170, 180, 190, or 200 percent of the length of the reference sequence. A percent identity for any candidate nucleic acid or polypeptide relative to a reference nucleic acid or polypeptide can be determined as follows. A reference sequence (e.g., a nucleic acid sequence or an amino acid sequence) is aligned to one or more candidate sequences using the computer program ClustalW (version 1.83, default parameters), which allows alignments of nucleic acid or polypeptide sequences to be carried out across their entire length (global alignment). Chenna et al., *Nucleic Acids Res.,* 31(13): 3497-500 (2003).

ClustalW calculates the best match between a reference and one or more candidate sequences, and aligns them so that identities, similarities and differences can be determined. Gaps of one or more residues can be inserted into a reference sequence, a candidate sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For multiple alignment of nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The ClustalW output is a sequence alignment that reflects the relationship between sequences. ClustalW can be run, for example, at the Baylor College of Medicine Search Launcher site on the World Wide Web (searchlauncher.bcm.tmc.edu/multi-align/multi-align.html) and at the European Bioinformatics Institute site on the World Wide Web (ebi.ac.uk/clustalw).

To determine percent identity of a candidate nucleic acid or amino acid sequence to a reference sequence, the sequences are aligned using ClustalW, the number of identical matches in the alignment is divided by the length of the reference sequence, and the result is multiplied by 100. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 554. Amino acid sequences of polypeptides having greater than 45% sequence identity to the polypeptide set forth in SEQ ID NO: 554 are provided in FIG. 1 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 263. Amino acid sequences of polypeptides having greater than 45% sequence identity to the polypeptide set forth in SEQ ID NO: 263 are provided in FIG. 2 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 117. Amino acid sequences of polypeptides having greater than 45% sequence identity to the polypeptide set forth in SEQ ID NO: 117 are provided in FIG. 3 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 1. Amino acid sequences of polypeptides having greater than 45% sequence identity to the polypeptide set forth in SEQ ID NO: 1 are provided in FIG. 4 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 645. Amino acid sequences of polypeptides having greater than 45% sequence identity to the polypeptide set forth in SEQ ID NO: 645 are provided in FIG. 5 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 253. Amino acid sequences of polypeptides having greater than 45% sequence identity to the polypeptide set forth in SEQ ID NO: 253 are provided in FIG. 6 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 323. Amino acid sequences of polypeptides having greater than 45% sequence identity to the polypeptide set forth in SEQ ID NO: 323 are provided in FIG. 7 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 595. Amino acid sequences of polypeptides having greater than 45% sequence identity to the polypeptide set forth in SEQ ID NO: 595 are provided in FIG. 8 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 77. Amino acid sequences of polypeptides having greater than 45% sequence identity to the polypeptide set forth in SEQ ID NO: 77 are provided in FIG. 9 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 209. Amino acid sequences of polypeptides having greater than 45% sequence identity to the polypeptide set forth in SEQ ID NO: 209 are provided in FIG. 10 and in the Sequence Listing.

In some cases, a biomass-modulating polypeptide has an amino acid sequence with at least 45% sequence identity, e.g., 50%, 52%, 56%, 59%, 61%, 65%, 70%, 75%, 80%, 85%, 90%, 95%, 97%, 98%, or 99% sequence identity, to the amino acid sequence set forth in SEQ ID NO: 426. Amino acid sequences of polypeptides having greater than 45% sequence identity to the polypeptide set forth in SEQ ID NO: 426 are provided in FIG. 11 and in the Sequence Listing.

E. Other Sequences

It should be appreciated that a biomass-modulating polypeptide can include additional amino acids that are not involved in biomass modulation, and thus such a polypeptide can be longer than would otherwise be the case. For example, a biomass-modulating polypeptide can include a purification tag, a chloroplast transit peptide, a mitochondrial transit peptide, an amyloplast peptide, or a leader sequence added to the amino or carboxy terminus. In some embodiments, a biomass-modulating polypeptide includes an amino acid sequence that functions as a reporter, e.g., a green fluorescent protein or yellow fluorescent protein.

III. NUCLEIC ACIDS

Nucleic acids described herein include nucleic acids that are effective to modulate biomass levels when transcribed in a plant or plant cell. Such nucleic acids include, without limitation, those that encode a biomass-modulating polypeptide and those that can be used to inhibit expression of a biomass-modulating polypeptide via a nucleic acid based method.

A. Nucleic acids encoding biomass-modulating polypeptides Nucleic acids encoding biomass-modulating polypeptides are described herein. Examples of such nucleic acids include SEQ ID NOs: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696 as described in more detail below. A nucleic acid also can be a fragment that is at least 40% (e.g., at least 45, 50, 55, 60, 65, 70, 75, 80, 85, 90, 95, or 99%) of the length of the full-length nucleic acid set forth in SEQ ID NOs: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696.

A biomass-modulating nucleic acid can comprise the nucleotide sequence set forth in SEQ ID NO: 553. Alternatively, a biomass-modulating nucleic acid can be a variant of the nucleic acid having the nucleotide sequence set forth in SEQ ID NO: 553. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 553.

A biomass-modulating nucleic acid can comprise the nucleotide sequence set forth in SEQ ID NO: 262. Alternatively, a biomass-modulating nucleic acid can be a variant of the nucleic acid having the nucleotide sequence set forth in SEQ ID NO: 262. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 262.

A biomass-modulating nucleic acid can comprise the nucleotide sequence set forth in SEQ ID NO: 116. Alternatively, a biomass-modulating nucleic acid can be a variant of the nucleic acid having the nucleotide sequence set forth in SEQ ID NO: 116. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 116.

A biomass-modulating nucleic acid can comprise the nucleotide sequence set forth in SEQ ID NO: 678. Alternatively, a biomass-modulating nucleic acid can be a variant of the nucleic acid having the nucleotide sequence set forth in SEQ ID NO: 678. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 678.

A biomass-modulating nucleic acid can comprise the nucleotide sequence set forth in SEQ ID NO: 644. Alternatively, a biomass-modulating nucleic acid can be a variant of the nucleic acid having the nucleotide sequence set forth in SEQ ID NO: 644. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 644.

A biomass-modulating nucleic acid can comprise the nucleotide sequence set forth in SEQ ID NO: 252. Alternatively, a biomass-modulating nucleic acid can be a variant of the nucleic acid having the nucleotide sequence set forth in SEQ ID NO: 252. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 252.

A biomass-modulating nucleic acid can comprise the nucleotide sequence set forth in SEQ ID NO: 322. Alternatively, a biomass-modulating nucleic acid can be a variant of the nucleic acid having the nucleotide sequence set forth in SEQ ID NO: 322. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 322.

A biomass-modulating nucleic acid can comprise the nucleotide sequence set forth in SEQ ID NO: 594. Alternatively, a biomass-modulating nucleic acid can be a variant of the nucleic acid having the nucleotide sequence set forth in SEQ ID NO: 594. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 594.

A biomass-modulating nucleic acid can comprise the nucleotide sequence set forth in SEQ ID NO: 76. Alternatively, a biomass-modulating nucleic acid can be a variant of the nucleic acid having the nucleotide sequence set forth in SEQ ID NO: 76. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 76.

A biomass-modulating nucleic acid can comprise the nucleotide sequence set forth in SEQ ID NO: 208. Alternatively, a biomass-modulating nucleic acid can be a variant of the nucleic acid having the nucleotide sequence set forth in SEQ ID NO: 208. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 208.

A biomass-modulating nucleic acid can comprise the nucleotide sequence set forth in SEQ ID NO: 425. Alternatively, a biomass-modulating nucleic acid can be a variant of the nucleic acid having the nucleotide sequence set forth in SEQ ID NO: 425. For example, a biomass-modulating nucleic acid can have a nucleotide sequence with at least 80% sequence identity, e.g., 81%, 85%, 90%, 95%, 97%, 98%, or 99% sequence identity, to the nucleotide sequence set forth in SEQ ID NO: 425.

Isolated nucleic acid molecules can be produced by standard techniques. For example, polymerase chain reaction (PCR) techniques can be used to obtain an isolated nucleic acid containing a nucleotide sequence described herein. PCR can be used to amplify specific sequences from DNA as well as RNA, including sequences from total genomic DNA or total cellular RNA. Various PCR methods are described, for example, in PCR Primer: A Laboratory Manual, Dieffenbach and Dveksler, eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies also are available by which site-specific nucleotide sequence modifications can be introduced into a template nucleic acid. Isolated nucleic acids also can be chemically synthesized, either as a single nucleic acid molecule (e.g., using automated DNA synthesis in the 3' to 5' direction using phosphoramidite technology) or as a series of oligonucleotides. For example, one or more pairs of long oligonucleotides (e.g., >100 nucleotides) can be synthesized that contain the desired sequence, with each pair containing a short segment of complementarity (e.g., about 15 nucleotides) such that a duplex is formed when the oligonucleotide pair is annealed. DNA polymerase is used to extend the oligonucleotides, resulting in a single, double-stranded nucleic acid molecule per oligonucleotide pair, which then can be ligated into a vector. Isolated nucleic acids of the invention also can be obtained by mutagenesis of, e.g., a naturally occurring DNA.

B. Use of Nucleic Acids to Modulate Expression of Polypeptides i. Expression of a Biomass-Modulating Polypeptide A nucleic acid encoding one of the biomass-modulating polypeptides described herein can be used to express the polypeptide in a plant species of interest, typically by transforming a plant cell with a nucleic acid having the coding sequence for the polypeptide operably linked in sense orientation to one or more regulatory regions. It will be appreciated that because of the degeneracy of the genetic code, a number of nucleic acids can encode a particular biomass-modulating polypeptide; i.e., for many amino acids, there is more than one nucleotide triplet that serves as the codon for the amino acid. Thus, codons in the coding sequence for a given biomass-modulating polypeptide can be modified such that optimal expression in a particular plant species is obtained, using appropriate codon bias tables for that species.

In some cases, expression of a biomass-modulating polypeptide inhibits one or more functions of an endogenous polypeptide. For example, a nucleic acid that encodes a dominant negative polypeptide can be used to inhibit protein function. A dominant negative polypeptide typically is mutated or truncated relative to an endogenous wild type polypeptide, and its presence in a cell inhibits one or more functions of the wild type polypeptide in that cell, i.e., the dominant negative polypeptide is genetically dominant and confers a loss of function. The mechanism by which a dominant negative polypeptide confers such a phenotype can vary but often involves a protein-protein interaction or a protein-DNA interaction. For example, a dominant negative polypeptide can be an enzyme that is truncated relative to a native wild type enzyme, such that the truncated polypeptide retains domains involved in binding a first protein but lacks domains involved in binding a second protein. The truncated polypeptide is thus unable to properly modulate the activity of the second protein. See, e.g., US 2007/0056058. As another example, a point mutation that results in a non-conservative amino acid substitution in a catalytic domain can result in a dominant negative polypeptide. See, e.g., US 2005/032221. As another example, a dominant negative polypeptide can be a transcription factor that is truncated relative to a native wild type transcription factor, such that the truncated polypeptide retains the DNA binding domain(s) but lacks the activation domain(s). Such a truncated polypeptide can inhibit the wild type transcription factor from binding DNA, thereby inhibiting transcription activation.

ii. Inhibition of Expression of a Biomass-Modulating Polypeptide

Polynucleotides and recombinant constructs described herein can be used to inhibit expression of a biomass-modulating polypeptide in a plant species of interest. See, e.g., Matzke and Birchler, *Nature Reviews Genetics* 6:24-35 (2005); Akashi et al., *Nature Reviews Mol. Cell Biology* 6:413-422 (2005); Mittal, *Nature Reviews Genetics* 5:355-365 (2004); and *Nature Reviews RNA interference collection*, October 2005 on the World Wide Web at nature.com/reviews/focus/mai. A number of nucleic acid based methods, including antisense RNA, ribozyme directed RNA cleavage, post-transcriptional gene silencing (PTGS), e.g., RNA interference (RNAi), and transcriptional gene silencing (TGS) are known to inhibit gene expression in plants. Suitable polynucleotides include full-length nucleic acids encoding biomass-modulating polypeptides or fragments of such full-length nucleic acids. In some embodiments, a complement of the full-length nucleic acid or a fragment thereof can be used. Typically, a fragment is at least 10 nucleotides, e.g., at least 12, 13, 14, 15, 16, 17, 18, 19, 20, 21, 22, 23, 24, 25, 26, 27, 30, 35, 40, 50, 80, 100, 200, 500 nucleotides or more. Generally, higher homology can be used to compensate for the use of a shorter sequence.

Antisense technology is one well-known method. In this method, a nucleic acid of a gene to be repressed is cloned and operably linked to a regulatory region and a transcription termination sequence so that the antisense strand of RNA is transcribed. The recombinant construct is then transformed into plants, as described herein, and the antisense strand of RNA is produced. The nucleic acid need not be the entire sequence of the gene to be repressed, but typically will be substantially complementary to at least a portion of the sense strand of the gene to be repressed.

In another method, a nucleic acid can be transcribed into a ribozyme, or catalytic RNA, that affects expression of an mRNA. See, U.S. Pat. No. 6,423,885. Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman et al., *Proc. Natl. Acad. Sci. USA*, 92(13): 6175-6179 (1995); de Feyter and Gaudron, Methods in Molecular Biology, Vol. 74, Chapter 43, "Expressing Ribozymes in Plants", Edited by Turner, P. C., Humana Press Inc., Totowa, N.J. RNA endoribonucleases which have been described, such as the one that occurs naturally in *Tetrahymena thermophila*, can be useful. See, for example, U.S. Pat. Nos. 4,987,071 and 6,423,885.

PTGS, e.g., RNAi, can also be used to inhibit the expression of a gene. For example, a construct can be prepared that includes a sequence that is transcribed into an RNA that can anneal to itself, e.g., a double stranded RNA having a stem-loop structure. In some embodiments, one strand of the stem portion of a double stranded RNA comprises a sequence that is similar or identical to the sense coding sequence or a fragment thereof of a biomass-modulating polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises a sequence that is similar or identical to the antisense strand or a fragment thereof of the coding sequence of the biomass-modulating polypeptide, and can have a length that is shorter, the same as, or longer than the corresponding length of the sense sequence. In some cases, one strand of the stem portion of a double stranded RNA comprises a sequence that is similar or identical to the 3' or 5' untranslated region, or a fragment thereof, of an mRNA encoding a biomass-modulating polypeptide, and the other strand of the stem portion of the double stranded RNA comprises a sequence that is similar or identical to the sequence that is complementary to the 3' or 5' untranslated region, respectively, or a fragment thereof, of the mRNA encoding the biomass-modulating polypeptide. In other embodiments, one strand of the stem portion of a double stranded RNA comprises a sequence that is similar or identical to the sequence of an intron, or a fragment thereof, in the pre-mRNA encoding a biomass-modulating polypeptide, and the other strand of the stem portion comprises a sequence that is similar or identical to the sequence that is complementary to the sequence of the intron, or a fragment thereof, in the pre-mRNA.

The loop portion of a double stranded RNA can be from 3 nucleotides to 5,000 nucleotides, e.g., from 3 nucleotides to 25 nucleotides, from 15 nucleotides to 1,000 nucleotides, from 20 nucleotides to 500 nucleotides, or from 25 nucleotides to 200 nucleotides. The loop portion of the RNA can include an intron or a fragment thereof. A double stranded RNA can have zero, one, two, three, four, five, six, seven, eight, nine, ten, or more stem-loop structures.

A construct including a sequence that is operably linked to a regulatory region and a transcription termination sequence, and that is transcribed into an RNA that can form a double stranded RNA, is transformed into plants as described herein. Methods for using RNAi to inhibit the expression of a gene are known to those of skill in the art. See, e.g., U.S. Pat. Nos. 5,034,323; 6,326,527; 6,452,067; 6,573,099; 6,753,139; and 6,777,588. See also WO 97/01952; WO 98/53083; WO 99/32619; WO 98/36083; and U.S. Patent Publications 20030175965, 20030175783, 20040214330, and 20030180945.

Constructs containing regulatory regions operably linked to nucleic acid molecules in sense orientation can also be used to inhibit the expression of a gene. The transcription product can be similar or identical to the sense coding sequence, or a fragment thereof, of a biomass-modulating polypeptide. The transcription product also can be unpolyadenylated, lack a 5' cap structure, or contain an unspliceable intron. Methods of inhibiting gene expression using a full-length cDNA as well as a partial cDNA sequence are known in the art. See, e.g., U.S. Pat. No. 5,231,020.

In some embodiments, a construct containing a nucleic acid having at least one strand that is a template for both sense and antisense sequences that are complementary to each other is used to inhibit the expression of a gene. The sense and antisense sequences can be part of a larger nucleic acid molecule or can be part of separate nucleic acid molecules having sequences that are not complementary. The sense or antisense sequence can be a sequence that is identical or complementary to the sequence of an mRNA, the 3' or 5' untranslated region of an mRNA, or an intron in a pre-mRNA encoding a biomass-modulating polypeptide, or a fragment of such sequences. In some embodiments, the sense or antisense sequence is identical or complementary to a sequence of the regulatory region that drives transcription of the gene encoding a biomass-modulating polypeptide. In each case, the sense sequence is the sequence that is complementary to the antisense sequence.

The sense and antisense sequences can be a length greater than about 10 nucleotides (e.g., 12, 13, 14, 15, 16, 17, 18, 19, 20, 21, 22, 23, 24, 25, 26, 27, 28, 29, 30, or more nucleotides). For example, an antisense sequence can be 21 or 22 nucleotides in length. Typically, the sense and antisense sequences range in length from about 15 nucleotides to about 30 nucleotides, e.g., from about 18 nucleotides to about 28 nucleotides, or from about 21 nucleotides to about 25 nucleotides.

In some embodiments, an antisense sequence is a sequence complementary to an mRNA sequence, or a fragment thereof, encoding a biomass-modulating polypeptide described herein. The sense sequence complementary to the antisense sequence can be a sequence present within the mRNA of the biomass-modulating polypeptide. Typically, sense and antisense sequences are designed to correspond to a 15-30 nucleotide sequence of a target mRNA such that the level of that target mRNA is reduced.

In some embodiments, a construct containing a nucleic acid having at least one strand that is a template for more than one sense sequence (e.g., 2, 3, 4, 5, 6, 7, 8, 9, 10 or more sense sequences) can be used to inhibit the expression of a gene. Likewise, a construct containing a nucleic acid having at least one strand that is a template for more than one antisense sequence (e.g., 2, 3, 4, 5, 6, 7, 8, 9, 10 or more antisense sequences) can be used to inhibit the expression of a gene. For example, a construct can contain a nucleic acid having at least one strand that is a template for two sense sequences and two antisense sequences. The multiple sense sequences can be identical or different, and the multiple antisense sequences can be identical or different. For example, a construct can have a nucleic acid having one strand that is a template for two identical sense sequences and two identical antisense sequences that are complementary to the two identical sense sequences. Alternatively, an isolated nucleic acid can have one strand that is a template for (1) two identical sense sequences 20 nucleotides in length, (2) one antisense sequence that is complementary to the two identical sense sequences 20 nucleotides in length, (3) a sense sequence 30 nucleotides in length, and (4) three identical antisense sequences that are complementary to the sense sequence 30 nucleotides in length. The constructs provided herein can be designed to have a suitable arrangement of sense and antisense sequences. For example, two identical sense sequences can be followed by two identical antisense sequences or can be positioned between two identical antisense sequences.

A nucleic acid having at least one strand that is a template for one or more sense and/or antisense sequences can be operably linked to a regulatory region to drive transcription of an RNA molecule containing the sense and/or antisense sequence(s). In addition, such a nucleic acid can be operably linked to a transcription terminator sequence, such as the terminator of the nopaline synthase (nos) gene. In some cases, two regulatory regions can direct transcription of two transcripts: one from the top strand, and one from the bottom strand. See, for example, Yan et al., *Plant Physiol.*, 141: 1508-1518 (2006). The two regulatory regions can be the same or different. The two transcripts can form double-stranded RNA molecules that induce degradation of the target RNA. In some cases, a nucleic acid can be positioned within a T-DNA or plant-derived transfer DNA (P-DNA) such that the left and right T-DNA border sequences or the left and right border-like sequences of the P-DNA flank, or are on either side of, the nucleic acid. See, US 2006/0265788. The nucleic acid sequence between the two regulatory regions can be from about 15 to about 300 nucleotides in length. In some embodiments, the nucleic acid sequence between the two regulatory regions is from about 15 to about 200 nucleotides in length, from about 15 to about 100 nucleotides in length, from about 15 to about 50 nucleotides in length, from about 18 to about 50 nucleotides in length, from about 18 to about 40 nucleotides in length, from about 18 to about 30 nucleotides in length, or from about 18 to about 25 nucleotides in length.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, *Antisense Nucleic Acid Drug Dev.*, 7:187-195 (1997); Hyrup et al., *Bioorgan. Med. Chem.*, 4:5-23 (1996). In addition, the deoxyphosphate backbone can be replaced with, for example, a phosphorothioate or phosphorodithioate backbone, a phosphoroamidite, or an alkyl phosphotriester backbone.

C. Constructs/Vectors

Recombinant constructs provided herein can be used to transform plants or plant cells in order to modulate biomass levels. A recombinant nucleic acid construct can comprise a nucleic acid encoding a biomass-modulating polypeptide as described herein, operably linked to a regulatory region suitable for expressing the biomass-modulating polypeptide in the plant or cell. Thus, a nucleic acid can comprise a coding sequence that encodes a biomass-modulating polypeptides as set forth in SEQ ID NOs: 1, 2, 4, 6, 8, 10, 11, 12, 13, 14, 15, 16, 17, 18, 20, 22, 24, 25, 27, 29, 30, 32, 33, 34, 36, 37, 38, 39, 40, 41, 43, 45, 47, 49, 50, 51, 53, 54, 56, 58, 59, 61, 63, 64, 66, 68, 70, 71, 72, 74, 75, 77, 79, 81, 82, 84, 86, 87, 88, 90, 92, 94, 96, 98, 100, 102, 104, 106, 108, 110, 112, 114, 115, 117, 118, 120, 121, 122, 123, 125, 127, 129, 131, 132, 133, 135, 137, 139, 141, 142, 144, 145, 146, 147, 149, 151, 152, 153, 154, 155, 156, 158, 160, 162, 163, 164, 166, 168, 169, 171, 173, 174, 176, 178, 180, 182, 184, 185, 186, 188, 189, 190, 191, 193, 194, 195, 196, 198, 200, 202, 203, 204, 206, 207, 209, 210, 212, 214, 216, 218, 220, 222, 224, 226, 228, 230, 232, 234, 236, 238, 239, 241, 242, 243, 244, 245, 246, 247, 248, 249, 250, 251, 253, 255, 257, 259, 261, 263, 264, 266, 268, 269, 271, 273, 275, 276, 278, 279, 281, 282, 283, 285, 287, 289, 291, 292, 294, 295, 296, 297, 298, 299, 300, 302, 304, 305, 306, 308, 310, 311, 312, 314, 315, 317, 319, 320, 321, 323, 324, 326, 327, 329, 331, 332, 334, 336, 337, 338, 340, 342, 343, 345, 347, 349, 351, 353, 354, 356, 357, 359, 361, 363, 365, 367, 369, 371, 372, 374, 376, 378, 380, 382, 384, 386, 388, 390, 391, 393, 395, 397, 399, 401, 403, 405, 406, 407, 409, 411, 413, 415, 416, 417, 418, 420, 421, 422, 424, 426, 428, 429, 430, 431, 433, 435, 436, 437, 438, 439, 440, 442, 444, 446, 447, 448, 449, 450, 452, 453, 454, 455, 456, 457, 459, 461, 463, 464, 466, 467, 468, 470, 472, 474, 476, 478, 479, 480, 482, 483, 484, 486, 488, 490, 492, 493, 495, 497, 499, 500, 501, 502, 503, 504, 506, 508, 509, 511, 513, 515, 516, 517, 518, 519, 521, 523, 525, 526, 528, 529, 531, 532, 534, 536, 537, 539, 540, 541, 543, 545, 547, 549, 550, 551, 552, 554, 556, 558, 560, 562, 563, 565, 567, 569, 571, 573, 574, 575, 577, 579, 581, 583, 585, 587, 589, 591, 593, 595, 597, 598, 600, 602, 603, 604, 605, 606, 608, 609, 610, 611, 613, 615, 616, 618, 619, 620, 622, 623, 625, 627, 629, 630, 632, 633, 634, 636, 637, 638, 639, 641, 642, 643, 645, 647, 649, 651, 652, 653, 655, 657, 659, 660, 662, 664, 666, 667, 669, 670, 671, 672, 673, 674, 675, 676, 677, 689, 691, 693, 695, or 697. Examples of nucleic acids encoding biomass-modulating polypeptides are set forth in SEQ ID NO: 3, 5, 7, 9, 19, 21, 23, 26, 28, 31, 35, 42, 44, 46, 48, 52, 55, 57, 60, 62, 65, 67, 69, 73, 76, 78, 80, 83, 85, 89, 91, 93, 95, 97, 99, 101, 103, 105, 107, 109, 111, 113, 116, 119, 124, 126, 128, 130, 134, 136, 138, 140, 143, 148, 150, 157, 159, 161, 165, 167, 170, 172, 175, 177, 179, 181, 183, 187, 192, 197, 199, 201, 205, 208, 211, 213, 215, 217, 219, 221, 223, 225, 227, 229, 231, 233, 235, 237, 240, 252, 254, 256, 258, 260, 262, 265, 267, 270, 272, 274, 277, 280, 284, 286, 288, 290, 293, 301, 303, 307, 309, 313, 316, 318, 322, 325, 328, 330, 333, 335, 339, 341, 344, 346, 348, 350, 352, 355, 358, 360, 362, 364, 366, 368, 370, 373, 375, 377, 379, 381, 383, 385, 387, 389, 392, 394, 396, 398, 400, 402, 404, 408, 410, 412, 414, 419, 423, 425, 427, 432, 434, 441, 443, 445, 451, 458, 460, 462, 465, 469, 471, 473, 475, 477, 481, 485, 487, 489, 491, 494, 496, 498, 505, 507, 510, 512, 514, 520, 522, 524, 527, 530, 533, 535, 538, 542, 544, 546, 548, 553, 555, 557, 559, 561, 564, 566, 568, 570, 572, 576, 578, 580, 582, 584, 586, 588, 590, 592, 594, 596, 599, 601, 607, 612, 614, 617, 621, 624, 626, 628, 631, 635, 640, 644, 646, 648, 650, 654, 656, 658, 661, 663, 665, 668, 678, 679, 680, 681, 682, 683, 684, 685, 686, 687, 688, 690, 692, 694, or 696, or in the Sequence Listing. The biomass-modulating polypeptide encoded by a recombinant nucleic acid can be a native biomass-modulating polypeptide, or can be heterologous to the cell. In some cases, the recombinant construct contains a nucleic acid that inhibits expression of a biomass-modulating polypeptide, operably linked to a regulatory region. Examples of suitable regulatory regions are described in the section entitled "Regulatory Regions."

Vectors containing recombinant nucleic acid constructs such as those described herein also are provided. Suitable vector backbones include, for example, those routinely used in the art such as plasmids, viruses, artificial chromosomes, BACs, YACs, or PACs. Suitable expression vectors include, without limitation, plasmids and viral vectors derived from, for example, bacteriophage, baculoviruses, and retroviruses. Numerous vectors and expression systems are commercially available from such corporations as Novagen® (Madison, Wis.), Clontech® (Palo Alto, Calif.), Stratagene® (La Jolla, Calif.), and Invitrogen/Life Technologies® (Carlsbad, Calif.).

The vectors provided herein also can include, for example, origins of replication, scaffold attachment regions (SARs), and/or markers. A marker gene can confer a selectable phenotype on a plant cell. For example, a marker can confer biocide resistance, such as resistance to an antibiotic (e.g., kanamycin, G418, bleomycin, or hygromycin), or an herbicide (e.g., glyphosate, chlorsulfuron or phosphinothricin). In addition, an expression vector can include a tag sequence designed to facilitate manipulation or detection (e.g., purification or localization) of the expressed polypeptide. Tag sequences, such as luciferase, β-glucuronidase (GUS), green fluorescent protein (GFP), glutathione 5-transferase (GST), polyhistidine, c-myc, hemagglutinin, or Flag™ tag (Kodak, New Haven, Conn.) sequences typically are expressed as a fusion with the encoded polypeptide. Such tags can be inserted anywhere within the polypeptide, including at either the carboxyl or amino terminus.

D. Regulatory Regions

The choice of regulatory regions to be included in a recombinant construct depends upon several factors, including, but not limited to, efficiency, selectability, inducibility, desired expression level, and cell- or tissue-preferential expression. It is a routine matter for one of skill in the art to modulate the expression of a coding sequence by appropriately selecting and positioning regulatory regions relative to the coding sequence. Transcription of a nucleic acid can be modulated in a similar manner.

Some suitable regulatory regions initiate transcription only, or predominantly, in certain cell types. Methods for identifying and characterizing regulatory regions in plant genomic DNA are known, including, for example, those described in the following references: Jordano et al., *Plant Cell*, 1:855-866 (1989); Bustos et al., *Plant Cell*, 1:839-854 (1989); Green et al., *EMBO J.*, 7:4035-4044 (1988); Meier et al., *Plant Cell*, 3:309-316 (1991); and Zhang et al., *Plant Physiology*, 110:1069-1079 (1996).

Examples of various classes of regulatory regions are described below. Some of the regulatory regions indicated below as well as additional regulatory regions are described in more detail in U.S. Patent Application Ser. Nos. 60/505,689; 60/518,075; 60/544,771; 60/558,869; 60/583,691; 60/619,181; 60/637,140; 60/757,544; 60/776,307; 10/957,569; 11/058,689; 11/172,703; 11/208,308; 11/274,890; 60/583,609; 60/612,891; 11/097,589; 11/233,726; 11/408,791; 11/414,142; 10/950,321; 11/360,017; PCT/US05/011105; PCT/US05/23639; PCT/US05/034308; PCT/US05/034343; and PCT/US06/038236; PCT/US06/040572; and PCT/US07/62762.

For example, the sequences of regulatory regions p326, YP0144, YP0190, p13879, YP0050, p32449, 21876, YP0158, YP0214, YP0380, PT0848, PT0633, YP0128, YP0275, PT0660, PT0683, PT0758, PT0613, PT0672, PT0688, PT0837, YP0092, PT0676, PT0708, YP0396, YP0007, YP0111, YP0103, YP0028, YP0121, YP0008, YP0039, YP0115, YP0119, YP0120, YP0374, YP0101, YP0102, YP0110, YP0117, YP0137, YP0285, YP0212, YP0097, YP0107, YP0088, YP0143, YP0156, PT0650, PT0695, PT0723, PT0838, PT0879, PT0740, PT0535, PT0668, PT0886, PT0585, YP0381, YP0337, PT0710, YP0356, YP0385, YP0384, YP0286, YP0377, PD1367, PT0863, PT0829, PT0665, PT0678, YP0086, YP0188, YP0263, PT0743 and YP0096 are set forth in the sequence listing of PCT/US06/040572; the sequence of regulatory region PT0625 is set forth in the sequence listing of PCT/US05/034343; the sequences of regulatory regions PT0623, YP0388, YP0087, YP0093, YP0108, YP0022 and YP0080 are set forth in the sequence listing of U.S. patent application Ser. No. 11/172,703; the sequence of regulatory region PR0924 is set forth in the sequence listing of PCT/US07/62762; and the sequences of regulatory regions p530c10, pOsFIE2-2, pOsMEA, pOsYp102, and pOsYp285 are set forth in the sequence listing of PCT/US06/038236.

It will be appreciated that a regulatory region may meet criteria for one classification based on its activity in one plant species, and yet meet criteria for a different classification based on its activity in another plant species.

i. Broadly Expressing Promoters

A promoter can be said to be "broadly expressing" when it promotes transcription in many, but not necessarily all, plant tissues. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326, YP0144, YP0190, p13879, YP0050, p32449, 21876, YP0158, YP0214, YP0380, PT0848, and PT0633 promoters. Additional examples include the cauliflower mosaic virus (CaMV) 35S promoter, the mannopine synthase (MAS) promoter, the 1' or 2' promoters derived from T-DNA of *Agrobacterium tumelaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

ii. Root Promoters

Root-active promoters confer transcription in root tissue, e.g., root endodermis, root epidermis, or root vascular tissues. In some embodiments, root-active promoters are root-preferential promoters, i.e., confer transcription only or predominantly in root tissue. Root-preferential promoters include the YP0128, YP0275, PT0625, PT0660, PT0683, and PT0758 promoters. Other root-preferential promoters include the PT0613, PT0672, PT0688, and PT0837 promoters, which drive transcription primarily in root tissue and to a lesser extent in ovules and/or seeds. Other examples of root-preferential promoters include the root-specific subdomains of the CaMV 35S promoter (Lam et al., *Proc. Natl. Acad. Sci. USA*, 86:7890-7894 (1989)), root cell specific promoters reported by Conkling et al., *Plant Physiol.*, 93:1203-1211 (1990), and the tobacco RD2 promoter.

iii. Maturing Endosperm Promoters

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin promoter (Bustos et al., *Plant Cell*, 1(9): 839-853 (1989)), the soybean trypsin inhibitor promoter (Riggs et al., *Plant Cell*, 1(6): 609-621 (1989)), the ACP promoter (Baerson et al., *Plant Mol. Biol.*, 22(2): 255-267 (1993)), the stearoyl-ACP desaturase promoter (Slocombe et al., *Plant Physiol.*, 104(4): 167-176 (1994)), the soybean α' subunit β-conglycinin promoter (Chen et al., *Proc. Natl. Acad. Sci. USA*, 83:8560-8564 (1986)), the oleosin promoter (Hong et al., *Plant Mol. Biol.*, 34(3): 549-555 (1997)), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al., *Mol. Cell Biol.*, 13:5829-5842 (1993)), the beta-amylase promoter, and the barley hordein promoter. Other maturing endosperm promoters include the YP0092, PT0676, and PT0708 promoters.

iv. Ovary Tissue Promoters

Promoters that are active in ovary tissues such as the ovule wall and mesocarp can also be useful, e.g., a polygalacturonidase promoter, the banana TRX promoter, the melon actin promoter, YP0396, and PT0623. Examples of promoters that are active primarily in ovules include YP0007, YP0111, YP0092, YP0103, YP0028, YP0121, YP0008, YP0039, YP0115, YP0119, YP0120, and YP0374.

v. Embryo Sac/Early Endosperm Promoters

To achieve expression in embryo sac/early endosperm, regulatory regions can be used that are active in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmyc1 (see, Urao, *Plant Mol. Biol.*, 32:571-57 (1996); Conceicao, *Plant*, 5:493-505 (1994)); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan, *Genetics*, 142:1009-1020 (1996)); maize Cat3 (see, GenBank No. L05934; Abler, *Plant Mol. Biol.*, 22:10131-1038 (1993)). Other promoters include the following *Arabidopsis* promoters: YP0039, YP0101, YP0102, YP0110, YP0117, YP0119, YP0137, DME, YP0285, and YP0212. Other promoters that may be useful include the following rice promoters: p530c10, pOsFIE2-2, pOsMEA, pOsYp102, and pOsYp285.

vi. Embryo Promoters

Regulatory regions that preferentially drive transcription in zygotic cells following fertilization can provide embryo-preferential expression. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* 20:647-654 (2001)), YP0097, YP0107, YP0088, YP0143, YP0156, PT0650, PT0695, PT0723, PT0838, PT0879, and PT0740.

vii. Photosynthetic Tissue Promoters

Promoters active in photosynthetic tissue confer transcription in green tissues such as leaves and stems. Most suitable are promoters that drive expression only or predominantly in such tissues. Examples of such promoters include the ribulose-1,5-bisphosphate carboxylase (RbcS) promoters such as the RbcS promoter from eastern larch (*Larix laricina*), the pine cab6 promoter (Yamamoto et al., *Plant Cell Physiol.*, 35:773-778 (1994)), the Cab-1 promoter from wheat (Fejes et al., *Plant Mol. Biol.*, 15:921-932 (1990)), the CAB-1 promoter from spinach (Lubberstedt et al., *Plant Physiol.*, 104:997-1006 (1994)), the cab1R promoter from rice (Luan et al., *Plant Cell*, 4:971-981 (1992)), the pyruvate orthophosphate dikinase (PPDK) promoter from corn (Matsuoka et al., *Proc. Natl. Acad. Sci. USA*, 90:9586-9590 (1993)), the tobacco Lhcb1*2 promoter (Cerdan et al., *Plant Mol. Biol.*, 33:245-255 (1997)), the *Arabidopsis thaliana* SUC2 sucrose-H+ symporter promoter (Truernit et al., *Planta*, 196:564-570 (1995)), and thylakoid membrane protein promoters from spinach (psaD, psaF, psaE, PC, FNR, atpC, atpD, cab, rbcS). Other photosynthetic tissue promoters include PT0535, PT0668, PT0886, YP0144, YP0380 and PT0585.

viii. Vascular Tissue Promoters

Examples of promoters that have high or preferential activity in vascular bundles include YP0087, YP0093, YP0108, YP0022, and YP0080. Other vascular tissue-preferential promoters include the glycine-rich cell wall protein GRP 1.8 promoter (Keller and Baumgartner, *Plant Cell*, 3(10): 1051-1061 (1991)), the Commelina yellow mottle virus (CoYMV) promoter (Medberry et al., *Plant Cell*, 4(2): 185-192 (1992)), and the rice tungro bacilliform virus (RTBV) promoter (Dai et al., *Proc. Natl. Acad. Sci. USA*, 101(2): 687-692 (2004)).

ix. Inducible Promoters

Inducible promoters confer transcription in response to external stimuli such as chemical agents or environmental stimuli. For example, inducible promoters can confer transcription in response to hormones such as giberellic acid or ethylene, or in response to light or drought. Examples of drought-inducible promoters include YP0380, PT0848, YP0381, YP0337, PT0633, YP0374, PT0710, YP0356, YP0385, YP0396, YP0388, YP0384, PT0688, YP0286, YP0377, PD1367, and PD0901. Examples of nitrogen-inducible promoters include PT0863, PT0829, PT0665, and PT0886. Examples of shade-inducible promoters include PR0924 and PT0678. An example of a promoter induced by salt is rd29A (Kasuga et al. (1999) Nature Biotech 17: 287-291).

x. Basal Promoters

A basal promoter is the minimal sequence necessary for assembly of a transcription complex required for transcription initiation. Basal promoters frequently include a "TATA box" element that may be located between about 15 and about 35 nucleotides upstream from the site of transcription initiation. Basal promoters also may include a "CCAAT box" element (typically the sequence CCAAT) and/or a GGGCG sequence, which can be located between about 40 and about 200 nucleotides, typically about 60 to about 120 nucleotides, upstream from the transcription start site.

xi. Stem Promoters

A stem promoter may be specific to one or more stem tissues or specific to stem and other plant parts. Stem promoters may have high or preferential activity in, for example, epidermis and cortex, vascular cambium, procambium, or xylem. Examples of stem promoters include YP0018 which is disclosed in US20060015970 and CryIA (b) and CryIA(c) (Braga et al. 2003, Journal of New Seeds 5:209-221).

xii. Other Promoters

Other classes of promoters include, but are not limited to, shoot-preferential, callus-preferential, trichome cell-preferential, guard cell-preferential such as PT0678, tuber-preferential, parenchyma cell-preferential, and senescence-preferential promoters. Promoters designated YP0086, YP0188, YP0263, PT0758, PT0743, PT0829, YP0119, and YP0096, as described in the above-referenced patent applications, may also be useful.

xiii. Other Regulatory Regions

A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

It will be understood that more than one regulatory region may be present in a recombinant polynucleotide, e.g., introns, enhancers, upstream activation regions, transcription terminators, and inducible elements. Thus, for example, more than one regulatory region can be operably linked to the sequence of a polynucleotide encoding a biomass-modulating polypeptide.

Regulatory regions, such as promoters for endogenous genes, can be obtained by chemical synthesis or by subcloning from a genomic DNA that includes such a regulatory region. A nucleic acid comprising such a regulatory region can also include flanking sequences that contain restriction enzyme sites that facilitate subsequent manipulation.

IV. TRANSGENIC PLANTS AND PLANT CELLS

A. Transformation

The invention also features transgenic plant cells and plants comprising at least one recombinant nucleic acid construct described herein. A plant or plant cell can be transformed by having a construct integrated into its genome, i.e., can be stably transformed. Stably transformed cells typically retain the introduced nucleic acid with each cell division. A plant or plant cell can also be transiently transformed such that the construct is not integrated into its genome. Transiently transformed cells typically lose all or some portion of the introduced nucleic acid construct with each cell division such that the introduced nucleic acid cannot be detected in daughter cells after a sufficient number of cell divisions. Both transiently transformed and stably transformed transgenic plants and plant cells can be useful in the methods described herein.

Transgenic plant cells used in methods described herein can constitute part or all of a whole plant. Such plants can be grown in a manner suitable for the species under consideration, either in a growth chamber, a greenhouse, or in a field. Transgenic plants can be bred as desired for a particular purpose, e.g., to introduce a recombinant nucleic acid into other lines, to transfer a recombinant nucleic acid to other species, or for further selection of other desirable traits. Alternatively, transgenic plants can be propagated vegetatively for those species amenable to such techniques. As used herein, a transgenic plant also refers to progeny of an initial transgenic plant provided the progeny inherits the transgene. Seeds produced by a transgenic plant can be grown and then selfed (or outcrossed and selfed) to obtain seeds homozygous for the nucleic acid construct.

Transgenic plants can be grown in suspension culture, or tissue or organ culture. For the purposes of this invention, solid and/or liquid tissue culture techniques can be used. When using solid medium, transgenic plant cells can be placed directly onto the medium or can be placed onto a filter that is then placed in contact with the medium. When using liquid medium, transgenic plant cells can be placed onto a flotation device, e.g., a porous membrane that contacts the liquid medium. A solid medium can be, for example, Murashige and Skoog (MS) medium containing agar and a suitable concentration of an auxin, e.g., 2,4-dichlorophenoxyacetic acid (2,4-D), and a suitable concentration of a cytokinin, e.g., kinetin.

When transiently transformed plant cells are used, a reporter sequence encoding a reporter polypeptide having a reporter activity can be included in the transformation procedure and an assay for reporter activity or expression can be performed at a suitable time after transformation. A suitable time for conducting the assay typically is about 1-21 days after transformation, e.g., about 1-14 days, about 1-7 days, or about 1-3 days. The use of transient assays is particularly convenient for rapid analysis in different species, or to confirm expression of a heterologous biomass-modulating polypeptide whose expression has not previously been confirmed in particular recipient cells.

Techniques for introducing nucleic acids into monocotyledonous and dicotyledonous plants are known in the art, and include, without limitation, Agrobacterium-mediated transformation, viral vector-mediated transformation, electroporation and particle gun transformation, e.g., U.S. Pat. Nos. 5,538,880; 5,204,253; 6,329,571 and 6,013,863. If a cell or cultured tissue is used as the recipient tissue for transformation, plants can be regenerated from transformed cultures if desired, by techniques known to those skilled in the art.

B. Screening/Selection

A population of transgenic plants can be screened and/or selected for those members of the population that have a trait or phenotype conferred by expression of the transgene. For example, a population of progeny of a single transformation event can be screened for those plants having a desired level of expression of a biomass-modulating polypeptide or nucleic acid. Physical and biochemical methods can be used to identify expression levels. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known. As an alternative, a population of plants comprising independent transformation events can be screened for those plants having a desired trait, such as a modulated level of biomass. Selection and/or screening can be carried out over one or more generations, and/or in more than one geographic location. In some cases, transgenic plants can be grown and selected under conditions which induce a desired phenotype or are otherwise necessary to produce a desired phenotype in a transgenic plant. In addition, selection and/or screening can be applied during a particular developmental stage in which the phenotype is expected to be exhibited by the plant. Selection and/or screening can be carried out to choose those transgenic plants having a statistically significant difference in a biomass level relative to a control plant that lacks the transgene. Selected or screened transgenic plants have an altered phenotype as compared to a corresponding control plant, as described in the "Transgenic Plant Phenotypes" section herein.

C. Plant Species

The polynucleotides and vectors described herein can be used to transform a number of monocotyledonous and dicotyledonous plants and plant cell systems, including species from one of the following families: Acanthaceae, Alliaceae, Alstroemeriaceae, Amaryllidaceae, Apocynaceae, Arecaceae, Asteraceae, Berberidaceae, Bixaceae, Brassicaceae, Bromeliaceae, Cannabaceae, Caryophyllaceae, Cephalotaxaceae, Chenopodiaceae, Colchicaceae, Cucurbitaceae, Dioscoreaceae, Ephedraceae, Erythroxylaceae, Euphorbiaceae, Fabaceae, Lamiaceae, Linaceae, Lycopodiaceae, Malvaceae, Melanthiaceae, Musaceae, Myrtaceae, Nyssaceae, Papaveraceae, Pinaceae, Plantaginaceae, Poaceae, Rosaceae, Rubiaceae, Salicaceae, Sapindaceae, Solanaceae, Taxaceae, Theaceae, or Vitaceae.

Suitable species may include members of the genus *Abelmoschus, Abies, Acer, Agrostis, Allium, Alstroemeria, Ananas, Andrographis, Andropogon, Artemisia, Arundo, Atropa, Berberis, Beta, Bixa, Brassica, Calendula, Camellia, Camptotheca, Cannabis, Capsicum, Carthamus, Catharanthus, Cephalotaxus, Chrysanthemum, Cinchona, Citrullus, Coffea, Colchicum, Coleus, Cucumis, Cucurbita, Cynodon, Datura, Dianthus, Digitalis, Dioscorea, Elaeis, Ephedra, Erianthus, Erythroxylum, Eucalyptus, Festuca, Fragaria, Galanthus, Glycine, Gossypium, Helianthus, Hevea, Hordeum, Hyoscyamus, Jatropha, Lactuca, Linum, Lolium, Lupinus, Lycopersicon, Lycopodium, Manihot, Medicago, Mentha, Miscanthus, Musa, Nicotiana, Oryza, Panicum, Papaver, Parthenium, Pennisetum, Petunia, Phalaris, Phleum, Pinus, Poa, Poinsettia, Populus, Rauwolfia, Ricinus, Rosa, Saccharum, Salix, Sanguinaria, Scopolia, Secale, Solanum, Sorghum, Spartina, Spinacea, Tanacetum, Taxus, Theobroma, Triticosecale, Triticum, Uniola, Veratrum, Vinca, Vitis,* and *Zea.*

Suitable species include *Panicum* spp., *Sorghum* spp., *Miscanthus* spp., *Saccharum* spp., *Erianthus* spp., *Populus* spp., *Andropogon gerardii* (big bluestem), *Pennisetum purpureum* (elephant grass), *Phalaris arundinacea* (reed canarygrass), *Cynodon dactylon* (bermudagrass), *Festuca arundinacea* (tall fescue), *Spartina pectinata* (prairie cordgrass), *Medicago sativa* (alfalfa), *Arundo donax* (giant reed), *Secale cereale* (rye), *Salix* spp. (willow), *Eucalyptus* spp. (eucalyptus), Triticosecale (triticum—wheat×rye) and bamboo.

Suitable species also include *Helianthus annuus* (sunflower), *Carthamus tinctorius* (safflower), *Jatropha curcas* (jatropha), *Ricinus communis* (castor), *Elaeis guineensis* (palm), *Linum usitatissimum* (flax), and *Brassica juncea.*

Suitable species also include *Beta vulgaris* (sugarbeet), and *Manihot esculenta* (cassava)

Suitable species also include *Lycopersicon esculentum* (tomato), *Lactuca sativa* (lettuce), *Musa paradisiaca* (banana), *Solanum tuberosum* (potato), *Brassica oleracea* (broccoli, cauliflower, Brussels sprouts), *Camellia sinensis* (tea), *Fragaria ananassa* (strawberry), *Theobroma cacao* (cocoa), *Coffea arabica* (coffee), *Vitis vinifera* (grape), *Ananas comosus* (pineapple), *Capsicum annum* (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), and *Solanum melongena* (eggplant).

Suitable species also include *Papaver somniferum* (opium poppy), *Papaver orientale, Taxus baccata, Taxus brevifolia, Artemisia annua, Cannabis sativa, Camptotheca acuminate, Catharanthus roseus, Vinca rosea, Cinchona officinalis, Colchicum autumnale, Veratrum califbrnica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus wornorii, Scopolia* spp., *Lycopodium serratum (Huperzia serrata), Lycopodium* spp., *Rauwolfia serpentina, Rauwolfia* spp., *Sanguinaria canadensis, Hyoscyamus* spp., *Calendula officinalis, Chrysanthemum parthenium, Coleus forskohlii,* and *Tanacetum parthenium.*

Suitable species also include *Parthenium argentatum* (guayule), *Hevea* spp. (rubber), *Mentha spicata* (mint), *Mentha piperita* (mint), *Bixa orellana,* and *Alstroemeria* spp.

Suitable species also include *Rosa* spp. (rose), *Dianthus caryophyllus* (carnation), *Petunia* spp. (petunia) and *Poinsettia pulcherrima* (poinsettia).

Suitable species also include *Nicotiana tabacum* (tobacco), *Lupinus albus* (lupin), *Uniola paniculata* (oats), bentgrass (*Agrostis* spp.), *Populus tremuloides* (aspen), *Pinus* spp. (pine), *Abies* spp. (fir), *Acer* spp. (maple), *Hordeum vulgare* (barley), *Poa pratensis* (bluegrass), *Lolium* spp. (ryegrass) and *Phleum pratense* (timothy).

In some embodiments, a suitable species can be a wild, weedy, or cultivated *Pennisetum* species such as, but not limited to, *Pennisetum alopecuroides, Pennisetum arnhemi-*

*cum, Pennisetum caffrum, Pennisetum clandestinum, Pennisetum divisum, Pennisetum glaucum, Pennisetum latifolium, Pennisetum macrostachyum, Pennisetum macrourum, Pennisetum orientale, Pennisetum pedicellatum, Pennisetum polystachion, Pennisetum polystachion* ssp. *Setosum, Pennisetum purpureum, Pennisetum setaceum, Pennisetum subangustum, Pennisetum typhoides, Pennisetum villosum*, or hybrids thereof (e.g., *Pennisetum purpureum×Pennisetum typhoidum*).

In some embodiments, a suitable species can be a wild, weedy, or cultivated *Miscanthus* species and/or variety such as, but not limited to, *Miscanthus×giganteus, Miscanthus sinensis, Miscanthus×ogiformis, Miscanthus floridulus, Miscanthus transmorrisonensis, Miscanthus oligostachyus, Miscanthus nepalensis, Miscanthus sacchariflorus, Miscanthus×giganteus* 'Amuri', *Miscanthus×giganteus* 'Nagara', *Miscanthus×giganteus* 'Illinois', *Miscanthus sinensis* var. 'Goliath', *Miscanthus sinensis* var. 'Roland', *Miscanthus sinensis* var. 'Africa', *Miscanthus sinensis* var. 'Fern Osten', *Miscanthus sinensis* var. *gracillimus, Miscanthus sinensis* var. *variegates, Miscanthus sinensis* var. *purpurascens, Miscanthus sinensis* var. 'Malepartus', *Miscanthus sacchariflorus* var. 'Robusta', *Miscanthus sinensis* var. 'Silberfedher' (aka. Silver Feather), *Miscanthus transmorrisonensis, Miscanthus condensatus, Miscanthus yakushimanum, Miscanthus* var. 'Alexander', *Miscanthus* var. 'Adagio', *Miscanthus* var. 'Autumn Light', *Miscanthus* var. 'Cabaret', *Miscanthus* var. 'Condensatus', *Miscanthus* var. 'Cosmopolitan', *Miscanthus* var. 'Dixieland', *Miscanthus* var. 'Gilded Tower' (U.S. Patent No. PP14,743), *Miscanthus* var. 'Gold Bar' (U.S. Patent No. PP15,193), *Miscanthus* var. 'Gracillimus', *Miscanthus* var. 'Graziella', *Miscanthus* var. 'Grosse Fontaine', *Miscanthus* var. 'Hinjo aka Little Nicky'™, *Miscanthus* var. 'Juli', *Miscanthus* var. 'Kaskade', *Miscanthus* var. 'Kirk Alexander', *Miscanthus* var. 'Kleine Fontaine', *Miscanthus* var. 'Kleine Silberspinne' (aka. 'Little Silver Spider'), *Miscanthus* var. 'Little Kitten', *Miscanthus* var. 'Little Zebra' (U.S. Patent No. PP13,008), *Miscanthus* var. 'Lottum', *Miscanthus* var. 'Malepartus', *Miscanthus* var. 'Morning Light', *Miscanthus* var. 'Mysterious Maiden' (U.S. Patent No. PP16,176), *Miscanthus* var. 'Nippon', *Miscanthus* var. 'November Sunset', *Miscanthus* var. 'Parachute', *Miscanthus* var. 'Positano', *Miscanthus* var. 'Puenktchen'(aka 'Little Dot'), *Miscanthus* var. 'Rigoletto', *Miscanthus* var. 'Sarabande', *Miscanthus* var. 'Silberpfeil' (aka. Silver Arrow), *Miscanthus* var. 'Silverstripe', *Miscanthus* var. 'Super Stripe' (U.S. Patent No. PP18,161), *Miscanthus* var. 'Strictus', or *Miscanthus* var. 'Zebrinus'.

In some embodiments, a suitable species can be a wild, weedy, or cultivated *sorghum* species and/or variety such as, but not limited to, *Sorghum almum, Sorghum amplum, Sorghum angustum, Sorghum arundinaceum, Sorghum bicolor* (such as bicolor, guinea, caudatum, kafir, and durra), *Sorghum brachypodum, Sorghum bulbosum, Sorghum burmahicum, Sorghum controversum, Sorghum drummondii, Sorghum ecarinatum, Sorghum exstans, Sorghum grande, Sorghum halepense, Sorghum interjectum, Sorghum intrans, Sorghum laxiflorum, Sorghum leiocladum, Sorghum macrospermum, Sorghum matarankense, Sorghum miliaceum, Sorghum nigrum, Sorghum nitidum, Sorghum plumosum, Sorghum propinquum, Sorghum purpureosericeum, Sorghum stipoideum, Sorghum sudanensese, Sorghum timorense, Sorghum trichocladum, Sorghum versicolor, Sorghum virgatum, Sorghum vulgare*, or hybrids such as *Sorghum×almum, Sorghum×sudangrass* or *Sorghum×drummondii*.

Thus, the methods and compositions can be used over a broad range of plant species, including species from the dicot genera *Brassica, Carthamus, Glycine, Gossypium, Helianthus, Jatropha, Parthenium, Populus*, and *Ricinus*; and the monocot genera *Elaeis, Festuca, Hordeum, Lolium, Oryza, Panicum, Pennisetum, Phleum, Poa, Saccharum, Secale, Sorghum, Triticosecale, Triticum*, and *Zea*. In some embodiments, a plant is a member of the species *Panicum virgatum* (switchgrass), *Sorghum bicolor* (sorghum, sudangrass), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutism* (cotton), *Oryza sativa* (rice), *Helianthus annuus* (sunflower), *Medicago sativa* (alfalfa), *Beta vulgaris* (sugarbeet), or *Pennisetum glaucum* (pearl millet).

In certain embodiments, the polynucleotides and vectors described herein can be used to transform a number of monocotyledonous and dicotyledonous plants and plant cell systems, wherein such plants are hybrids of different species or varieties of a specific species (e.g., *Saccharum* sp.× *Miscanthus* sp., *Sorghum* sp.×*Miscanthus* sp., e.g., *Panicum virgatum×Panicum amarum, Panicum virgatum×Panicum amarulum*, and *Pennisetum purpureum×Pennisetum typhoidum*).

D. Transgenic Plant Phenotypes

In some embodiments, a plant in which expression of a biomass-modulating polypeptide is modulated can have increased levels of biomass in plants. For example, a biomass-modulating polypeptide described herein can be expressed in a transgenic plant, resulting in increased levels of vegetative tissue. The biomass level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the biomass level in a corresponding control plant that does not express the transgene. In some embodiments, a plant in which expression of a biomass-modulating polypeptide is modulated can have decreased levels of seed production.

The level can be decreased by at least 2 percent, e.g., 2, 3, 4, 5, 10, 15, 20, 25, 30, 35, or more than 35 percent, as compared to the seed production level in a corresponding control plant that does not express the transgene.

Increases in seed production in such plants can provide improved nutritional availability in geographic locales where intake of plant foods is often insufficient, or for biofuel production. In some embodiments, decreases in biomass in such plants can be useful in situations where vegetative tissues are not the primary plant part that is harvested for human or animal consumption (i.e., seeds are harvested).

In some embodiments, a plant in which expression of a biomass-modulating polypeptide is modulated can have increased or decreased levels of biomass in one or more plant tissues, e.g., vegetative tissues, reproductive tissues, or root tissues. For example, the biomass level can be increased by at least 2 percent, e.g., 2, 3, 4, 5, 6, 7, 8, 9, 10, 11, 12, 13, 14, 15, 16, 17, 18, 19, 20, 25, 30, 35, 40, 45, 50, 55, 60, or more than 60 percent, as compared to the biomass level in a corresponding control plant that does not express the transgene. In some embodiments, a plant in which expression of a biomass-modulating polypeptide is modulated can have decreased levels of biomass in one or more plant tissues. The biomass level can be decreased by at least 2 percent, e.g., 2, 3, 4, 5, 10, 15, 20, 25, 30, 35, or more than 35 percent, as compared to the biomass level in a corresponding control plant that does not express the transgene.

Increases in biomass in such plants can provide improved food quantity, or improved energy production. Decreases in biomass can provide more efficient partitioning of nutrients to plant part(s) that are harvested for human or animal consumption.

Typically, a difference in the amount of biomass in a transgenic plant or cell relative to a control plant or cell is considered statistically significant at p≤0.05 with an appropriate parametric or non-parametric statistic, e.g., Chi-square test, Student's t-test, Mann-Whitney test, or F-test. In some embodiments, a difference in the amount of biomass is statistically significant at p<0.01, p<0.005, or p<0.001. A statistically significant difference in, for example, the amount of biomass in a transgenic plant compared to the amount of a control plant indicates that the recombinant nucleic acid present in the transgenic plant results in altered biomass levels.

The phenotype of a transgenic plant is evaluated relative to a control plant. A plant is said "not to express" a polypeptide when the plant exhibits less than 10%, e.g., less than 9%, 8%, 7%, 6%, 5%, 4%, 3%, 2%, 1%, 0.5%, 0.1%, 0.01%, or 0.001%, of the amount of polypeptide or mRNA encoding the polypeptide exhibited by the plant of interest. Expression can be evaluated using methods including, for example, RT-PCR, Northern blots, S1 RNase protection, primer extensions, Western blots, protein gel electrophoresis, immunoprecipitation, enzyme-linked immunoassays, chip assays, and mass spectrometry. It should be noted that if a polypeptide is expressed under the control of a tissue-preferential or broadly expressing promoter, expression can be evaluated in the entire plant or in a selected tissue. Similarly, if a polypeptide is expressed at a particular time, e.g., at a particular time in development or upon induction, expression can be evaluated selectively at a desired time period.

Biomass can include harvestable plant tissues such as leaves, stems, and reproductive structures, or all plant tissues such as leaves, stems, roots, and reproductive structures. In some embodiments, biomass encompasses only above ground plant parts. In some embodiments, biomass encompasses only stem plant parts. In some embodiments, biomass encompasses only above ground plant parts except inflorescence and seed parts of a plant. Biomass can be measured as described in the examples section. Biomass can be quantified as dry matter yield, which is the mass of biomass produced (usually reported in T/acre) if the contribution of water is subtracted from the fresh mater weight. Dry matter yield (DMY) yield is calculated using the fresh matter weight (FMW) and a measurement of weight percent moisture (M) in the following equation. DMY=((100-M)/100)*FMW. Biomass can be quantified as fresh matter yield, which is the mass of biomass produced (usually reported in T/acre) on an as-received basis, which includes the weight of moisture.

V. MODIFYING ENDOGENOUS NUCLEIC ACIDS ENCODING BIOMASS-MODULATING Polypeptides This document also features plant cells and plants in which an endogenous biomass-modulating nucleic acid described herein has been modified (e.g., a regulatory region, intron, or coding region of the biomass-modulating nucleic acid has been modified). The biomass of such plants is altered relative to the corresponding level of a control plant in which the endogenous nucleic acid is not modified. Such plants are referred to herein as modified plants and may be used to produce, for example, increased amounts of biomass.

Endogenous nucleic acid can be modified by homologous recombination techniques. For example, sequence specific endonucleases (e.g., zinc finger nucleases (ZFNs)) and meganucleases can be used to stimulate homologous recombination at endogenous plant genes. See, e.g., Townsend et al., *Nature* 459:442-445 (2009); Tovkach et al., *Plant J.*, 57:747-757 (2009); and Lloyd et al., *Proc. Natl. Acad. Sci. USA*, 102:2232-2237 (2005). In particular, ZFNs engineered to create DNA double strand breaks at specific loci can be used to make targeted sequence changes in endogenous plant genes. For example, an endogenous plant gene can be replaced with a variant containing one or more mutations (e.g., produced using site-directed mutagenesis or directed evolution).

In some embodiments, endogenous nucleic acids can be modified by methylation or demethylation such that the expression of the modified endogenous nucleic acid is altered. For example, a double stranded RNA can be used to activate gene expression by targeting noncoding regulatory regions in gene promoters. See Shibuya et al., *Proc Natl Acad Sci USA*, 106(5): 1660-1665 (2009); and Li et al., *Proc Natl Acad Sci USA*, 103(46): 17337-42 (2006).

In some embodiments, endogenous nucleic acids can be modified using activation tagging. For example, a vector containing multiple copies of an enhancer element from the constitutively active promoter of the cauliflower mosaic virus (CaMV) 35S gene can be used to activate an endogenous gene. See, Weigel et al., *Plant Physiology*, 122:1003-1013 (2000).

In some embodiments, endogenous nucleic acids can be modified by introducing an engineered transcription activation/repression factor (e.g., zinc finger protein transcription factor, or ZFP TF. See, for example, the world wide web at sangamo.com/tech/tech_plat_over.html#whatarezfp). An engineered transcription activation/repression factor (such as ZFP TF) can activate, repress, or switch the target endogenous biomass gene expression by binding specifically to the promoter region or coding region of the endogenous gene.

In some embodiments, endogenous nucleic acids can be modified by mutagenesis. Genetic mutations can be introduced within regenerable plant tissue using one or more mutagenic agents. Suitable mutagenic agents include, for example, ethyl methane sulfonate (EMS), N-nitroso-N-ethylurea (ENU), methyl N-nitrosoguanidine (MNNG), ethidium bromide, diepoxybutane, ionizing radiation, x-rays, UV rays and other mutagens known in the art. Suitable types of mutations include, for example, insertions or deletions of nucleotides, and transitions or transversions in the endogenous nucleic acid sequence. In one embodiment, TILLING (Targeted Induced Local Lesions In Genomes) can be used to produce plants having a modified endogenous nucleic acid. TILLING combines high-density mutagenesis with high-throughput screening methods. See, for example, McCallum et al., *Nat Biotechnol* 18: 455-457 (2000); reviewed by Stemple, *Nat Rev Genet* 5(2): 145-50 (2004).

In some embodiments, an endogenous nucleic acid can be modified via a gene silencing technique. See, for example, the section herein regarding "Inhibition of Expression of a Biomass-Modulating Polypeptide."

A population of plants can be screened and/or selected for those members of the population that have a modified nucleic acid. A population of plants also can be screened and/or selected for those members of the population that have a trait or phenotype conferred by expression of the modified nucleic acid. As an alternative, a population of plants can be screened for those plants having a desired trait, such as a modulated level of biomass. For example, a population of progeny can be screened for those plants having a desired level of expression of a biomass-modulating polypeptide or nucleic acid. Physical and biochemical methods can be used to identify modified nucleic acids and/or expression levels as described with transgenic plants. Selection and/or screening can be carried out over one or more generations, and/or in more than one geographic location. In some cases, plants can be grown and selected under conditions which induce a desired phenotype or are otherwise necessary to produce a desired phenotype in a modified plant. In addition, selection and/or screening can be applied during a particular developmental stage in which the phenotype is expected to be exhibited by the plant. Selection and/or screening can be carried out to choose those modified plants having a statistically significant difference in a biomass level relative to a control plant in which the nucleic acid has not been modified. Selected or screened modified plants have an altered phenotype as compared to a corresponding control plant, as described in the "Transgenic Plant Phenotypes" section herein.

Although a plant or plant cell in which an endogenous biomass-modulating nucleic acid has been modified is not transgenic for that particular nucleic acid, it will be appreciated that such a plant or cell may contain transgenes. For example, a modified plant can contain a transgene for other traits, such as herbicide tolerance or insect resistance. As another example, a modifed plant can contain one or more transgenes that, in conjuction with modifications of one or more endogenous nucleic acids, exhibits an increase in biomass.

As with transgenic plant cells, modified plant cells can constitute part or all of a whole plant. Such plants can be grown in the same manner as described for transgenic plants and can be bred or propagated in the same manner as described for transgenic plants.

VI. PLANT BREEDING

Genetic polymorphisms that are useful in such methods include simple sequence repeats (SSRs, or microsatellites), rapid amplification of polymorphic DNA (RAPDs), single nucleotide polymorphisms (SNPs), amplified fragment length polymorphisms (AFLPs) and restriction fragment length polymorphisms (RFLPs). SSR polymorphisms can be identified, for example, by making sequence specific probes and amplifying template DNA from individuals in the population of interest by PCR. For example, PCR techniques can be used to enzymatically amplify a genetic marker associated with a nucleotide sequence conferring a specific trait (e.g., nucleotide sequences described herein). PCR can be used to amplify specific sequences from DNA as well as RNA, including sequences from total genomic DNA or total cellular RNA. When using RNA as a source of template, reverse transcriptase can be used to synthesize complementary DNA (cDNA) strands. Various PCR methods are described, for example, in *PCR Primer: A Laboratory Manual*, Dieffenbach and Dveksler, eds., Cold Spring Harbor Laboratory Press, 1995.

Generally, sequence information from polynucleotides flanking the region of interest or beyond is employed to design oligonucleotide primers that are identical or similar in sequence to opposite strands of the template to be amplified. Primers are typically 14 to 40 nucleotides in length, but can range from 10 nucleotides to hundreds of nucleotides in length. Template and amplified DNA is repeatedly denatured at a high temperature to separate the double strand, then cooled to allow annealing of primers and the extension of nucleotide sequences through the microsatellite, resulting in sufficient DNA for detection of PCR products. If the probes flank an SSR in the population, PCR products of different sizes will be produced. See, e.g., U.S. Pat. No. 5,766,847.

PCR products can be qualitative or quantitatively analyzed using several techniques. For example, PCR products can be stained with a fluorescent molecule (e.g., PicoGreen® or OliGreen®) and detected in solution using spectrophotometry or capillary electrophoresis. In some cases, PCR products can be separated in a gel matrix (e.g., agarose or polyacrylamide) by electrophoresis, and size-fractionated bands comprising PCR products can be visualized using nucleic acid stains. Suitable stains can fluoresce under UV light (e.g., Ethidium bromide, GR Safe, SYBR® Green, or SYBR® Gold). The results can be visualized via transillumination or epi-illumination, and an image of the fluorescent pattern can be acquired using a camera or scanner, for example. The image can be processed and analyzed using specialized software (e.g., ImageJ) to measure and compare the intensity of a band of interest against a standard loaded on the same gel.

Alternatively, SSR polymorphisms can be identified by using PCR product(s) as a probe against Southern blots from different individuals in the population. See, U. H. Refseth et al., (1997) *Electrophoresis* 18: 1519. Briefly, PCR products are separated by length through gel electrophoresis and transferred to a membrane. SSR-specific DNA probes, such as oligonucleotides labeled with radioactive, fluorescent, or chromogenic molecules, are applied to the membrane and hybridize to bound PCR products with a complementary nucleotide sequence. The pattern of hybridization can be visualized by autoradiography or by development of color on the membrane, for example.

In some cases, PCR products can be quantified using a real-time thermocycler detection system. For example, Quantitative real-time PCR can use a fluorescent dye that forms a DNA-dye-complex (e.g., SYBR® Green), or a fluorophore-containing DNA probe, such as single-stranded oligonucleotides covalently bound to a fluorescent reporter or fluorophore (e.g. 6-carboxyfluorescein or tetrachlorofluorescin) and quencher (e.g., tetramethylrhodamine or dihydrocyclopyrroloindole tripeptide minor groove binder). The fluorescent signal allows detection of the amplified product in real time, thereby indicating the presence of a sequence of interest, and allowing quantification of the copy number of a sequence of interest in cellular DNA or expression level of a sequence of interest from cellular mRNA.

The identification of RFLPs is discussed, for example, in Alonso-Blanco et al. (*Methods in Molecular Biology*, vol. 82, "*Arabidopsis Protocols*", pp. 137-146, J. M. Martinez-Zapater and J. Salinas, eds., c. 1998 by Humana Press, Totowa, N.J.); Burr ("Mapping Genes with Recombinant Inbreds", pp. 249-254, in Freeling, M. and V. Walbot (Ed.), *The Maize Handbook*, c. 1994 by Springer-Verlag New York, Inc.: New York, N.Y., USA; Berlin Germany; Burr et al. *Genetics* (1998) 118: 519; and Gardiner, J. et al., (1993) *Genetics* 134: 917). For example, to produce a RFLP library enriched with single- or low-copy expressed sequences, total DNA can be digested with a methylation-sensitive enzyme (e.g., PstI). The digested DNA can be separated by size on a preparative gel. Polynucleotide fragments (500 to 2000 bp)

can be excised, eluted and cloned into a plasmid vector (e.g., pUC18). Southern blots of plasmid digests can be probed with total sheared DNA to select clones that hybridize to single- and low-copy sequences. Additional restriction endonucleases can be tested to increase the number of polymorphisms detected.

The identification of AFLPs is discussed, for example, in EP 0 534 858 and U.S. Pat. No. 5,878,215. In general, total cellular DNA is digested with one or more restriction enzymes. Restriction halfsite-specific adapters are ligated to all restriction fragments and the fragments are selectively amplified with two PCR primers that have corresponding adaptor and restriction site specific sequences. The PCR products can be visualized after size-fractionation, as described above.

In some embodiments, the methods are directed to breeding a plant line. Such methods use genetic polymorphisms identified as described above in a marker assisted breeding program to facilitate the development of lines that have a desired alteration in the biomass trait. Once a suitable genetic polymorphism is identified as being associated with variation for the trait, one or more individual plants are identified that possess the polymorphic allele correlated with the desired variation. Those plants are then used in a breeding program to combine the polymorphic allele with a plurality of other alleles at other loci that are correlated with the desired variation. Techniques suitable for use in a plant breeding program are known in the art and include, without limitation, backcrossing, mass selection, pedigree breeding, bulk selection, crossing to another population and recurrent selection. These techniques can be used alone or in combination with one or more other techniques in a breeding program. Thus, each identified plants is selfed or crossed a different plant to produce seed which is then germinated to form progeny plants. At least one such progeny plant is then selfed or crossed with a different plant to form a subsequent progeny generation. The breeding program can repeat the steps of selfing or outcrossing for an additional 0 to 5 generations as appropriate in order to achieve the desired uniformity and stability in the resulting plant line, which retains the polymorphic allele. In most breeding programs, analysis for the particular polymorphic allele will be carried out in each generation, although analysis can be carried out in alternate generations if desired.

In some cases, selection for other useful traits is also carried out, e.g., selection for fungal resistance or bacterial resistance. Selection for such other traits can be carried out before, during or after identification of individual plants that possess the desired polymorphic allele.

VII. ARTICLES OF MANUFACTURE

Transgenic plants provided herein have various uses in the agricultural and energy production industries. For example, transgenic plants described herein can be used to make animal feed and food products. Such plants, however, are often particularly useful as a feedstock for energy production.

Transgenic plants described herein often produce higher yields of grain and/or biomass per hectare, relative to control plants that lack the exogenous nucleic acid. In some embodiments, such transgenic plants provide equivalent or even increased yields of grain and/or biomass per hectare relative to control plants when grown under conditions of reduced inputs such as fertilizer and/or water. Thus, such transgenic plants can be used to provide yield stability at a lower input cost and/or under environmentally stressful conditions such as drought. In some embodiments, plants described herein have a composition that permits more efficient processing into free sugars, and subsequently ethanol, for energy production. In some embodiments, such plants provide higher yields of ethanol, butanol, dimethyl ether, other biofuel molecules, and/or sugar-derived co-products per kilogram of plant material, relative to control plants. Such processing efficiencies are believed to be derived from the composition of the plant material, including, but not limited to, content of glucan, cellulose, hemicellulose, and lignin. By providing higher biomass yields at an equivalent or even decreased cost of production, the transgenic plants described herein improve profitability for farmers and processors as well as decrease costs to consumers.

Seeds from transgenic plants described herein can be conditioned and bagged in packaging material by means known in the art to form an article of manufacture. Packaging material such as paper and cloth are well known in the art. A package of seed can have a label, e.g., a tag or label secured to the packaging material, a label printed on the packaging material, or a label inserted within the package, that describes the nature of the seeds therein.

The invention will be further described in the following examples, which do not limit the scope of the invention described in the claims.

VIII. EXAMPLES

Example 1

Transgenic Rice Plants

The following symbols are used in with respect to rice transformation: $T_0$: plant regenerated from transformed tissue culture; $T_1$: first generation progeny of self-pollinated $T_0$ plants; $T_2$: second generation progeny of self-pollinated $T_1$ plants; $T_3$: third generation progeny of self-pollinated $T_2$ plants.

The following is a list of nucleic acids that were isolated from *Arabidopsis thaliana* plants: CeresAnnot: 544549 (SEQ ID NO: 262), CeresAnnot: 1355066 (SEQ ID NO: 116), CeresClone: 1356785 (SEQ ID NO: 252), CeresClone: 26006 (SEQ ID NO: 594), CeresClone: 4831 (SEQ ID NO: 76), CeresAnnot: 847799 (SEQ ID NO: 208), and CeresAnnot: 878355 (SEQ ID NO: 425). The following nucleic acids were isolated from *Zea mays* plants: CeresClone: 1384304 (SEQ ID NO: 553). The following nucleic acids were isolated from *Oryza sativa* plants: antisense sequence (SEQ ID NO: 678). CeresClone: 638126 (SEQ ID NO: 322) was isolated from *Glycine max* plants.

Each isolated nucleic acid described above was cloned into a Ti plasmid vector containing a phosphinothricin acetyltransferase gene which confers Finale™ resistance to transformed plants. Constructs were made using the above mentioned nucleic acids that contained each operably linked to a 326 promoter construct was introduced into callus cells of the rice cultivar Kitaake by an *Agrobacterium*-mediated transformation protocol. Approximately 20-30 independent $T_0$ transgenic plants were generated from each transformation, as well as for the control plasmid (empty vector). Preliminary phenotypic analysis indicated that $T_0$ transformants did not show any significant phenotypic anomalies in vegetative organs, with a few exceptions where some plants appeared small with reduced fertility, most likely due to tissue culture effects.

$T_0$ plants were grown in a greenhouse, allowed to self-pollinate, and $T_1$ seeds collected. $T_1$ and $T_2$ plants were grown in a field. The presence of each construct was confirmed by PCR.

Rice seeds were soaked for 3-4 days before spring germination and transplanted to the field about one month later in Langfang, China. The distance between rows was 25 cm and the distance between plants was 15 cm. The combined fertilizer (16N-16P-16K) was applied at 25 kg/mu (666.7 m²) just before transplanting. 12.5 kg/mu of urea was applied at two times during the growing season prior to panicle development.

Ten plants were grown per transgenic event within one row. Only those rows that were visibly different from control plants were measured. Plant height was measured at maturity.

Biomass (Dry weight) measurements for CW00733, CW00710, CW00628, CW00604, CW00564, CW00469, and CW00536 were collected from $T_1$ plants that were grown. The stems with leaves and leaf sheaths but without panicles were dried in a greenhouse for at least a month, and then weighed for each plant (all tillers weighed together for each plant). Measurements for CW00191, CW00297, and CW00319 were collected from $T_2$ plants that were grown.

The stems with leaves and leaf sheaths but with panicles separated were dried in a room for at least a month, and then weighed for each plant (all tillers weighed together for each plant). Tiller number was counted after 4 months of growth.

Example 2

Results for Rice Events CW00733, Ceres Clone: 1384304, (SEQ ID NO: 553)

$T_1$ seed from one event of CW00733 containing Ceres-Clone: 1384304 was analyzed as described in Example 1. The plant height, biomass, and panicle weight of transgenic $T_1$ plants in comparison to plants not containing the transgene grown at the same location is shown in Table 1. Each table data row corresponds to a field row. The data points represent an average of 10 transgenic plants (1 row of same event) and an average of 40 control plants (4 rows). An increase in biomass, height and panicle weight was shown in comparison to plants not containing the transgene.

TABLE 1

| Plant Height (cm) | | Biomass (g)/plant | | Panicle wt (g)/plant | |
| --- | --- | --- | --- | --- | --- |
| Control | Transgenic | Control | Transgenic | Control | Transgenic |
| 72.41 | 80.30 | 16.70 | 27.45 | 21.56 | 28.89 |
|  |  |  | 24.58 |  | 23.42 |

The plant height (cm), yield (measured as g/per panicles of 16 plants), and biomass (measured as g of stem only (no inflorescence or root)) of transgenic $T_2$ CW00733 plants in comparison to plants not containing the transgene grown (WT) at the same location are shown in Table 2. Results from CW00604 events (Example 7) also are shown in Table 2. An increase in height and biomass was observed.

TABLE 2

T2 Plants from CW00733 and CW00604 events

|  | Rep | WT | CW00604 | CW00733 |
| --- | --- | --- | --- | --- |
| Height (cm) | Rep I | 80.3 | 81.3 | 85.0 |
|  | Rep II | 73.3 | 79.7 | 84.5 |
|  | Rep III | 77.2 | 79.1 | 82.9 |
|  | Average | 76.9 | 80.0 | 84.1 |
| Yield | Rep I | 395.4 | 357.0 | 356.8 |
|  | Rep II | 385.0 | 324.0 | 348.5 |
|  | Rep III | 361.6 | 309.0 | 345.3 |
|  | Average | 380.7 | 330.0 | 350.2 |
| Biomass | Rep I | 16.6 | 24.8 | 19.3 |
|  | Rep II | 20.0 | 20.8 | 17.7 |
|  | Rep III | 16.6 | 19.8 | 19.7 |
|  | Average | 17.7 | 21.8 | 18.9 |

Example 3

Results for Rice Events CW00319, Ceres Annot: 544549 (SEQ ID NO: 262)

Biomass from plants grown from $T_2$ and $T_3$ seed from one event of CW00319 containing Ceres Annot: 544549 was analyzed as described in Example 1. The average biomass of transgenic $T_2$ and $T_3$ plants in comparison to plants not containing the transgene grown at the same location is shown in Table 3. The low nitrogen plots and control plots were each replicated 3 times in randomized block design, having transgenic plants representing multiple events and controls. Each plot contained 40 plants. Ten plants were measured per plot for one event of CW00319. Each of the biomass values presented in Table 3 represents an average of 30 plants measured. The results show a measured increase in biomass for transgenic plants under low nitrogen conditions in comparison to plants not containing the transgene.

TABLE 3

| Biomass (g)/plant (normal) | | Biomass (g)/plant (Low N) | |
| --- | --- | --- | --- |
| Control | Transgenic | Control | Transgenic |
| 14.6 | 14.38 | 16.01 | 17.44 |

Example 4

Results for Rice Events CW00710, Ceres Annot: 1355066 (SEQ ID NO: 116)

$T_1$ seed from one event of CW00710 containing Ceres Annot: 1355066 was analyzed as described in Example 1. The plant height, biomass, and panicle weight of transgenic $T_1$ plants in comparison to plants not containing the transgene grown at the same location is shown in Table 4. The table data row corresponds to a field row. The data points represent an average of 10 transgenic plants (1 row of same event) and an average of 40 control plants (4 rows). An increase in biomass and height was shown in comparison to plants not containing the transgene.

TABLE 4

| Plant Height (cm) | | Biomass (g)/plant | | Panicle wt (g)/plant | |
|---|---|---|---|---|---|
| Control | Transgenic | Control | Transgenic | Control | Transgenic |
| 72.20 | 85.60 | 14.51 | 24.15 | 19.38 | 18.70 |

Example 5

Results for Rice Events CW00628 (SEQ ID NO: 678)

$T_1$ seed from one event of CW00628 containing SEQ ID NO: 678 RNAi construct was analyzed as described in Example 1. The plant height, biomass, and panicle weight of transgenic $T_1$ plants in comparison to plants not containing the transgene grown at the same location is shown in Table 5. The table data row corresponds to a field row. The data points represent an average of 10 transgenic plants (1 row of same event) and an average of 40 control plants (4 rows). An increase in biomass and height was shown in comparison to plants not containing the transgene.

TABLE 5

| Plant Height (cm) | | Biomass (g)/plant | | Panicle wt (g)/plant | |
|---|---|---|---|---|---|
| Control | Transgenic | Control | Transgenic | Control | Transgenic |
| 75.30 | 81.60 | 15.92 | 29.96 | 24.53 | 20.38 |

Example 6

Results for Rice Events CW00297, Ceres Clone: 625057 (SEQ ID NO: 644)

Biomass from plants grown from $T_2$ and $T_3$ seed from one event of CW00297 containing Ceres Clone: 625057 was analyzed as described in Example 1. The average biomass of transgenic $T_2$ and $T_3$ plants in comparison to plants not containing the transgene grown at the same location is shown in Table 6. The low nitrogen plots and control plots were each replicated 3 times in randomized block design, having transgenic plants representing multiple events and controls. Each plot contained 40 plants. Ten plants were measured per plot for one event of CW00297. Each of the biomass values presented in Table 6 represents an average of 30 plants measured. The results show a measured increase in biomass for transgenic plants under normal and low nitrogen conditions in comparison to plants not containing the transgene.

TABLE 6

| Biomass (g)/plant (normal) | | Biomass (g)/plant (Low N) | |
|---|---|---|---|
| Control | Transgenic | Control | Transgenic |
| 14.6 | 15.93 | 16.01 | 17.35 |

Example 7

Results for Rice Events CW00604, Ceres Clone: 1356785 (SEQ ID NO: 252)

$T_1$ seed from one event of CW00604 containing Ceres Clone: 1356785 was analyzed as described in Example 1. The plant height, biomass, and panicle weight of transgenic $T_1$ plants in comparison to plants not containing the transgene grown at the same location is shown in Table 7. Each table data row corresponds to a field row. The data points represent an average of 10 transgenic plants (1 row of same event) and an average of 40 control plants (4 rows). An increase in biomass, height and panicle weight was shown in comparison to plants not containing the transgene. An increase in height and biomass also was observed for $T_2$ plants. See Table 2.

TABLE 7

| Plant Height (cm) | | Biomass (g)/plant | | Panicle wt (g)/plant | |
|---|---|---|---|---|---|
| Control | Transgenic | Control | Transgenic | Control | Transgenic |
| 72.53 | 81.25 | 16.40 | 28.68 | 22.21 | 29.91 |
| 73.70 | 82.30 | | | | |

Example 8

Results for Rice Events CW00564, Ceres Clone: 638126 (SEQ ID NO: 322)

$T_1$ seed from one event of CW00564 containing Ceres Clone: 638126 was analyzed as described in Example 1. The plant height, biomass, and panicle weight of transgenic $T_1$ plants in comparison to plants not containing the transgene grown at the same location is shown in Table 8. The table data row corresponds to a field row. The data points represent an average of 10 transgenic plants (1 row of same event) and an average of 40 control plants (4 rows). An increase in biomass, height, and panicle weight was shown in comparison to plants not containing the transgene.

TABLE 8

| Plant Height (cm) | | Biomass (g)/plant | | Panicle wt (g)/plant | |
|---|---|---|---|---|---|
| Control | Transgenic | Control | Transgenic | Control | Transgenic |
| 72.88 | 85.44 | 18.11 | 36.47 | 22.56 | 37.47 |

The plant height (cm), yield (measured as g/per panicles of 16 plants), and biomass (measured as g of stem only (no inflorescence or root)) of transgenic $T_2$ CW00564 plants in comparison to plants not containing the transgene grown (WT) at the same location are shown in Table 9. Results from CW00469 events (Example 10) also are shown in Table 9. An increase in height, yield, and biomass was observed.

TABLE 9

| T2 Plants from CW00564 and CW00469 events | | | | |
|---|---|---|---|---|
| | Rep | WT | CW00469 | CW00564 |
| Height (cm) | Rep I | 77.3 | 117.1 | 90.7 |
| | Rep II | 76.9 | 117.7 | 91.5 |
| | Rep III | 77.4 | 113.1 | 92.7 |
| | Average | 77.2 | 115.9 | 91.6 |
| Yield | Rep I | 356.9 | 426.0 | 406.8 |
| | Rep II | 343.2 | 378.8 | 423.6 |
| | Rep III | 366.7 | 398.0 | — |
| | Average | 355.6 | 400.9 | 415.2 |

TABLE 9-continued

T2 Plants from CW00564 and CW00469 events

|  | Rep | WT | CW00469 | CW00564 |
|---|---|---|---|---|
| Biomass | Rep I | 17.1 | 29.7 | 25.2 |
|  | Rep II | 15.1 | 26.5 | 25.1 |
|  | Rep III | 14.6 | 27.1 | 24.4 |
|  | Average | 15.6 | 27.7 | 24.9 |

Example 9

Results for Rice Events CW00010, Ceres Clone: 26006 (SEQ ID NO: 594)

$T_1$ seed from three events of CW00010 containing Ceres Clone: 26006 was analyzed as described in Example 1. The plant height, biomass, tiller number, flowering time, and panicle weight of transgenic $T_1$ plants in comparison to plants not containing the transgene grown at the same location is shown in Tables 10, 11, and 12. The data points represent an average of 10 transgenic plants (1 row of same event) and an average of 40 control plants (4 rows). An increase in biomass, height, tiller number, and panicle weight was shown in comparison to plants not containing the transgene.

TABLE 10

Event 1

|  | Percent Increase | p value | Number of plants measured |
|---|---|---|---|
| Biomass | 9 | 0.307 | 11 |
| Plant Height | 7 | 0.028 | 11 |
| Tiller Number | 27 | 0.002 | 10 |
| Flowering Time | 10 | 0.048 | 11 |
| Panicle weight | 16 | 0.012 | 39 |

TABLE 11

Event 17

|  | Percent Increase | P value | Number of plants measured |
|---|---|---|---|
| Plant Height | 3 | 0.004 | 7 |
| Tiller Number | 34 |  | 1 |
| Panicle weight | 4 | 0.591 | 7 |

TABLE 12

Event 2

|  | Percent Increase | p value | Number of plants measured |
|---|---|---|---|
| Plant Height | 2 | 0.007 | 15 |
| Tiller Number | 27 | 0.013 | 10 |
| Panicle weight | 16 | 0.011 | 14 |

Example 10

Results for Rice Events CW00469, Ceres Clone: 4831(SEQ ID NO: 76)

$T_1$ seed from one event of CW00469 containing Ceres Clone: 4831 was analyzed as described in Example 1. The plant height, biomass, and panicle weight of transgenic $T_1$ plants in comparison to plants not containing the transgene grown at the same location is shown in Table 13. The table data row corresponds to a field row. The data points represent an average of 10 transgenic plants (1 row of same event) and an average of 40 control plants (4 rows). An increase in biomass, height, and panicle weight was shown in comparison to plants not containing the transgene. An increase in height, yield, and biomass was shown in $T_2$ plants (see Table 9).

TABLE 13

| Plant Height (cm) | | Biomass (g)/plant | | Panicle wt (g)/plant | |
|---|---|---|---|---|---|
| Control | Transgenic | Control | Transgenic | Control | Transgenic |
| 76.54 | 112.22 | 25.44 | 56.06 | 32.63 | 62.70 |

Example 11

Results for Rice Events CW00536, Ceres Annot: 847799 (SEQ ID NO: 208)

$T_1$ seed from 16 events of CW00536 containing Ceres Annot: 847799 was analyzed as described in Example 1. The plant height and panicle weight of transgenic $T_1$ plants in comparison to plants not containing the transgene grown at the same location is shown in Tables 14 and 15. The data points represent an average of 16 events with 15 transgenic plants per event and an average of several hundred control plants. An increase in height and panicle weight was shown in comparison to plants not containing the transgene.

TABLE 14

Panicle wt (g)/plant

| Control | STDEV | Transgenic | STDEV |
|---|---|---|---|
| 17.916 | 2.181 | 20.854 | 3.419 |

TABLE 15

Plant Height (cm)

| Event | Percent Increase over control |
|---|---|
| CW00536-03 | 7.79 |
| CW00536-05 | 5.66 |
| CW00536-11 | 8.71 |
| CW00536-12 | 8.47 |
| CW00536-20 | 8.77 |

Example 12

Results for Rice Events SR05004, CW00191, CeresAnnot: 878355 (SEQ ID NO: 425)

Biomass from plants grown from $T_2$ and $T_3$ seed from one event of CW00191 containing CeresAnnot: 878355 was analyzed as described in Example 1. The average biomass of transgenic $T_2$ and $T_3$ plants in comparison to plants not containing the transgene grown at the same location is shown in Table 16. The low nitrogen plots and control plots were each replicated 3 times in randomized block design, having transgenic plants representing multiple events and controls. Each plot contained 40 plants. Ten plants were measured per plot for one event of CW00191. Each of the biomass values presented in Table 16 represents an average of 30 plants measured. The results show a measured increase in biomass for transgenic plants under normal and low nitrogen conditions in comparison to plants not containing the transgene.

TABLE 16

| Biomass (g)/plant (normal) | | Biomass (g)/plant (Low N) | |
| --- | --- | --- | --- |
| Control | Transgenic | Control | Transgenic |
| 14.6 | 16.75 | 16.01 | 19.64 |

Example 13

Determination of Functional Homologs by Reciprocal BLAST

A candidate sequence was considered a functional homolog of a reference sequence if the candidate and reference sequences encoded proteins having a similar function and/or activity. A process known as Reciprocal BLAST (Rivera et al., *Proc. Natl. Acad. Sci. USA*, 95:6239-6244 (1998)) was used to identify potential functional homolog sequences from databases consisting of all available public and proprietary peptide sequences, including NR from NCBI and peptide translations from Ceres clones.

Before starting a Reciprocal BLAST process, a specific reference polypeptide was searched against all peptides from its source species using BLAST in order to identify polypeptides having BLAST sequence identity of 80% or greater to the reference polypeptide and an alignment length of 85% or greater along the shorter sequence in the alignment. The reference polypeptide and any of the aforementioned identified polypeptides were designated as a cluster.

The BLASTP version 2.0 program from Washington University at Saint Louis, Mo., USA was used to determine BLAST sequence identity and E-value. The BLASTP version 2.0 program includes the following parameters: 1) an E-value cutoff of 1.0e-5; 2) a word size of 5; and 3) the -postsw option. The BLAST sequence identity was calculated based on the alignment of the first BLAST HSP (High-scoring Segment Pairs) of the identified potential functional homolog sequence with a specific reference polypeptide. The number of identically matched residues in the BLAST HSP alignment was divided by the HSP length, and then multiplied by 100 to get the BLAST sequence identity. The HSP length typically included gaps in the alignment, but in some cases gaps were excluded.

The main Reciprocal BLAST process consists of two rounds of BLAST searches; forward search and reverse search. In the forward search step, a reference polypeptide sequence, "polypeptide A," from source species SA was BLASTed against all protein sequences from a species of interest. Top hits were determined using an E-value cutoff of $10^{-5}$ and a sequence identity cutoff of 35%. Among the top hits, the sequence having the lowest E-value was designated as the best hit, and considered a potential functional homolog or ortholog. Any other top hit that had a sequence identity of 80% or greater to the best hit or to the original reference polypeptide was considered a potential functional homolog or ortholog as well. This process was repeated for all species of interest.

In the reverse search round, the top hits identified in the forward search from all species were BLASTed against all protein sequences from the source species SA. A top hit from the forward search that returned a polypeptide from the aforementioned cluster as its best hit was also considered as a potential functional homolog.

Functional homologs were identified by manual inspection of potential functional homolog sequences. Representative functional homologs for SEQ ID NO: 554, 263, 117, 1, 645, 253, 323, 595, 77, 209, and 426 are shown in FIGS. 1-11, respectively. Additional exemplary homologs are correlated to certain Figures in the Sequence Listing.

Example 14

Determination of Functional Homologs by Hidden Markov Models

Hidden Markov Models (HMMs) were generated by the program HMMER 2.3.2. To generate each HMM, the default HMMER 2.3.2 program parameters, configured for global alignments, were used.

An HMM was generated using the sequences shown in FIG. 1 as input. These sequences were fitted to the model and a representative HMM bit score for each sequence is shown in the Sequence Listing. Additional sequences were fitted to the model, and representative HMM bit scores for any such additional sequences are shown in the Sequence Listing. The results indicate that these additional sequences are functional homologs of SEQ ID NO: 554.

The procedure above was repeated and an HMM was generated for each group of sequences shown in FIGS. 2-11, using the sequences shown in each Figure as input for that HMM. A representative bit score for each sequence is shown in the Sequence Listing. Additional sequences were fitted to certain HMMs, and representative HMM bit scores for such additional sequences are shown in the Sequence Listing. The results indicate that these additional sequences are functional homologs of the sequences used to generate that HMM.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (701 sequences)

SEQ ID NO: 1 - protein, 235 aa, Oryza sativa
  misc_feature (32)..(83): Pfam Name: AP2 Pfam Description: AP2 domain
  misc_feature: Bit score of 550.1 for HMM based on sequences of Figure 4
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAAAAAEAGYRMMKLAPPVTVAAVAQSDSDSSSVVDLAPSPPAVTANKAAAFDLDLNRPPPVEN

SEQ ID NO: 2 - protein, 246 aa, Triticum aestivum
  misc_feature (32)..(83): Pfam Name: AP2 Pfam Description: AP2 domain
  misc_feature: Public GI ID no. 84795244
  misc_feature: Bit score of 566.8 for HMM based on sequences of Figure 4
  misc_feature: Functional Homolog Of SEQ ID NO. 1
MAPRAAEKAPVSPPTGLGLGLGGGVGVVAGGAHYRGVRKRPWGRYAAEIRDPAKKSRVWLGTYDTAEEAARAYDTAAREFRGAKAKTNFPFPSSSSSSPVAGAGGGGSPSSDSTLDSSGGGSGGCAQAPMQAIPLPPALDLDLFHRAAAVTAVAGGGMRFPFNGYPVAPRQPMHPYFFYEQAAAAAAAASGYRALKVAQPVTVAAVARSDSDSSSVVDLSPSPPAVTAHKAVAFDLDLNRPPPSED

SEQ ID NO: 3 - DNA, 1052 bp, Panicum virgatum
  misc_feature: Ceres Clone ID no. 1725396
  misc_feature: Encodes the peptide sequence at SEQ ID NO. 4
agactccatacacccaccctctctacgcgcagctcctcgctgaaccggaacacccgcacacacacgccacttggacaccatggcgccccgggcggcggacaagtcgccggtgccgccggccaccggcctcggtctcggcgtcggcggtgccgtcggaggcctgggcatgggcccgcactacaggggcgtgcggaagcgcccgtgggggcggtacgccgcggagatccgcgacccggccaagaagagccgcgtgtggctgggaacgtacgacaccgccgaggaggccgcccgcgcctacgacgctgccgcgcgcgacttccgcggcgccaaggccaagaccaacttcccgttcgcgtcccagtgccccgtcgccgccggcgccggcgccggcagccccagcagcaactgcaccgtggaatcgcgcggaggcggcagcggctacggcgtccaggcgcccatgcaggccatgccgctgcccccggccctcgatctcgatctcttccaccgggcggcggccgtgaccgcggtctcccccggcggcatgcggtttcccttcaaagggtaccctgtcgcgcgcccgaccccgaacccctacttcttctacgaacaggcggcagcggccgcggccgcggcggccggctaccggatgctcaaggtcgccccgccgccggtcaccgtggccgccgtcgcgcagagcgactccgactcctcgtcggtggttgatcgcaccccttcgccgcccgcggttgccgcaaaaaaggaggtctccttcgatctggatctgaactggccgccgccggcggagaactagccacacccaccagagtttttagctgacgacttcgtagtttctctttcctttttgccttgaggaatattacttctgttatttttttttggtcctctagcctgtagttttgttcagtagcctgtgagagacggagaagcctgtgtacatagtttttccgccagaggacggaattgatctgttgctttcccaccccataaaccataaacgcaaaaaaaaaaacatcacatttgaatggttctag

SEQ ID NO: 4 - protein, 243 aa, Panicum virgatum
  misc_feature (32)..(83): Pfam Name: AP2 Pfam Description: AP2 domain
  misc_feature: Ceres Clone ID no. 1725396
  misc_feature: Bit score of 585.0 for HMM based on sequences of Figure 4
  misc_feature: Functional Homolog Of SEQ ID NO. 1
MAPRAADKSPVPPATGLGLGVGGAVGGLGMGPHYRGVRKRPWGRYAAEIRDPAKKSRVWLGTYDTAEEAARAYDAAARDFRGAKAKTNFPFASQCPVAAGAGAGSPSSNCTVESRGGGSGYGVQAPMQAMPLPPALDLDLFHRAAAVTAVSPGGMRFPFKGYPVARPTPNPYFFYEQAAAAAAAAAGYRMLKVAPPPVTVAAVAQSDSDSSSVVDRTPSPPAVAAKKEVSFDLDLNWPPPAEN

SEQ ID NO: 5 - DNA, 729 bp, Sorghum bicolor
  misc_feature: Ceres Annot ID no. 8669118
  misc_feature: Encodes the peptide sequence at SEQ ID NO. 6
atggcgccccgggtggcggacaagtcgccgttgccgccggccaccggcctcggactgggcgttggcggagtagtcggaggcgtgggcatgggcccacactacagaggcgtgagaaagcggccgtggggacgtttcgccgctgagatccgcgaccctgccaagaaaagccgcgtgtggctaggcacgtacgacacggccgaggaggccgccaaggcctacgacgccgccgcccgcgagttccgaggcgccaaggccaagacgaacttcccgttcccgtctcagtgcgccgtcgccgccggcggtgctggcagcccctgcagcaacagcaccgttgactcgagcggcggcgccagcggctgtgccgtccaggcgcctatgcaggccatgccgctgcctccggccctcgatctcgatctcttccatcgggcggccgccgtgaacgcggtcaccgcaggcggcatgcggtttccgttcaagggctaccccgtcgcgcgtccaaccccgcaccagtacttcttctacgaacaggccgccgcagccgctgccgcggcggccggctaccggatgcttaaggtggccccaccgccggtcaccgtggccgccgtcgcgcagagtgattcggactcctcgtctgtggttgatcacaccccttcgcctcccgcggtgacggcaaagaaggaggtgggcttcgagctggatctgaactggccgccgccggcagagaactag

SEQ ID NO: 6 - protein, 242 aa, Sorghum bicolor
  misc_feature (32)..(83): Pfam Name: AP2 Pfam Description: AP2 domain
  misc_feature: Ceres Annot ID no. 8669118
  misc_feature: Bit score of 594.1 for HMM based on sequences of Figure 4
  misc_feature: Functional Homolog Of SEQ ID NO. 1
MAPRVADKSPLPPATGLGLGVGGVVGGVGMGPHYRGVRKRPWGRFAAEIRDPAKKSRVWLGTYDTAEEAAKAYDAAAREFRGAKAKTNFPFPSQCAVAAGGAGSPCSNSTVDSSGGASGCAVQAPMQAMPLPPALDLDLFHRAAAVNAVTAGGMRFPFKGYPVARPTPHQYFFYEQAAAAAAAAAGYRMLKVAPPPVTVAAVAQSDSDSSSVVDHTPSPPAVTAKKEVGFELDLNWPPPAEN

SEQ ID NO: 7 - DNA, 994 bp, Zea mays
  misc_feature: Ceres Clone ID no. 280241
  misc_feature: Encodes the peptide sequence at SEQ ID NO. 8
aagacgcaatacacatacaccccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgcgtgtggctcggcacgtacgacacggccgaggaggccgccaaggcgtacgattccgccgcccgcgagttccgaggcgccaaggccaagacgaacttcccgttcccctcccagtgctccgtcgcctccgttgctgccggtagcgctagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttccgttcaagggctatcctgtcgcctgcccgacgccacagcagtactttttctacgagcaggcagcggccgcggctgccgcggcatccggataccggatgctcaaggtcgccccaccggccgtgactgtggccgcggtggcgcagagcgactccgactcgtcgtctgtggttgatcactccccttcgcctcccgcggtgacggaaaacaaggtgggcttcgaactggatctgaactggcccccgccggcagagaactaggcaggccgaagtttttggctgacgacttagtagcttctttttcccttttgccttcatcaggaatgttacttgtggttgtttggtcctgtatggctgtattcttgttctgtagactaagagatggggagtcttgtaaatattttttttccgtcgagacggaaatgaactgagatctgttcgtctgtccg

SEQ ID NO: 8 - protein, 240 aa, Zea mays
  misc_feature (32)..(83): Pfam Name: AP2 Pfam Description: AP2 domain
  misc_feature: Ceres Clone ID no. 280241
  misc_feature: Bit score of 586.0 for HMM based on sequences of Figure 4
  misc_feature: Functional Homolog Of SEQ ID NO. 1
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASVAAGSASSNSTVDSSGGGSGCGIQAPMQAMPLPPALDLDLFHRAAAVNAVSTGMRFPFKGYPVACPTPQQYFFYEQAAAAAAAASGYRMLKVAPPAVTVAAVAQSDSDSSSVVDHSPSPPAVTENKVGFELDLNWPPPAEN

SEQ ID NO: 9 - DNA, 805 bp, Musa acuminata
  misc_feature: Ceres Clone ID no. 1712594
  misc_feature: Encodes the peptide sequence at SEQ ID NO. 10
atcgcggaaaccgaaacagagggagaggatcgaacagtcgaaagaaaggcgtgtgagcttggttccttttccatggctccaagggggaagctcagcaccgtcgccgacggtgaagggaaggagatgcgtttccgaggggtgaggaagcggccgtggggccggtacgccgccgagatacgcgaccccagcaagaagacccgagtctggctcggtaccttcgacaccgcagaggaggccgccagagcctacgacaacgccgcccgcgatttccgcggcgccaaggccaagaccaacttcgccttctcagacgcctgcagcagccccagcgccgtcccggctgccactggcagccccagtagccagagcagcaccgtggaatcctcaggccgcgaggtggctgcggcggcggtgcctccactcgctgttccgctcccaccctccctcgatctgggcctcctctaccgcggcggaaccggcggtcgcttcccctttcagtcatacccaaccgccgccccgtcggcccagcagttctttttcctggacgcaaagtcggccacgaataaccgccagctggccctttgcccgccgatgttcgtcgcctgcttccagccgccgcccgccgtggccgtgcagagcgactccgactcctcctccgtcgtagatctccacccggactatcgctctcctcctccgcaggcgaaggcgttccctctcgctttcgacctcaacctccctccgccggaggagatcgtgtgactcggaagccgtcagaccgtcccccaaactcttccactcctctgatatc

SEQ ID NO: 10 - protein, 227 aa, Musa acuminata
  misc_feature (18)..(69): Pfam Name: AP2 Pfam Description: AP2 domain
  misc_feature: Ceres Clone ID no. 1712594
  misc_feature: Bit score of 504.5 for HMM based on sequences of Figure 4
  misc_feature: Functional Homolog Of SEQ ID NO. 1
MAPRGKLSTVADGEGKEMRFRGVRKRPWGRYAAEIRDPSKKTRVWLGTFDTAEEAARAYDNAARDFRGAKAKTNFAFSDACSSPSAVPAATGSPSSQSSTVESSGREVAAAAVPPLAVPLPPSLDLGLLYRGGTGGRFPFQSYPTAAPSAQQFFFLDAKSATNNRQLALCPPMFVACFQPPPAVAVQSDSDSSSVVDLHPDYRSPPPQAKAFPLAFDLNLPPPEEIV

SEQ ID NO: 11 - protein, 222 aa, Glycine max
  misc_feature (24)..(75): Pfam Name: AP2 Pfam Description: AP2 domain
  misc_feature: Public GI ID no. 190361125
  misc_feature: Bit score of 519.9 for HMM based on sequences of Figure 4
  misc_feature: Functional Homolog Of SEQ ID NO. 1
MAPRDHKTSNAKANGNGNSGVKEVHFRGVRKRPWGRYAAEIRDPGKKSRVWLGTFDTAEEAARAYDAAAREFRGPKAKTNFPLPLENVKNSSPSQSSTVESSSRDRDVAADSSPLDLNLAPAAAASARFPFQHQFPVFTGAVPAANQVLYFDAVLRAGMAGPRGFAFGYNHHPVAASEFHATTSDSDSSSVIDLNHNEGEVKGNGSRIFDLDLNHPPPHEIA

SEQ ID NO: 12 - protein, 239 aa, Stylosanthes hamata
  misc_feature (19)..(70): Pfam Name: AP2 Pfam Description: AP2 domain
  misc_feature: Public GI ID no. 4099921
  misc_feature: Bit score of 540.5 for HMM based on sequences of Figure 4
  misc_feature: Functional Homolog Of SEQ ID NO. 1
MAPREKTPAVKVNAGVKEVHFRGVRKRPWGRYAAEIRDPGKKSRVWLGTFDTAEDAARAYDAAAREFRGPKAKTNFPFPDSDDINSNNNNIVVVKNNNRSPSQSSTVESSSRDRDSYSAAAAATAVADSSPLDLNLAPAGAGFAGSIRFPFQQPFAVFPGGMPAAKQALYLDAVLRASMASHGQFGFGYNRPAAAAAGAQSDSDSSSVIDLNQNEGDVAKNNGRGLVLDLNEPPPQEMA

SEQ ID NO: 13 - protein, 220 aa, Vitis vinifera
  misc_feature (20)..(71): Pfam Name: AP2 Pfam Description: AP2 domain
  misc_feature: Public GI ID no. 147844573
  misc_feature: Bit score of 510.1 for HMM based on sequences of Figure 4
  misc_feature: Functional Homolog Of SEQ ID NO. 1
  misc_feature (81)..(81): Xaa is any aa, unknown, or other
  misc_feature (88)..(88): Xaa is any aa, unknown, or other
MAPRDKPTGVTAGATGNKEIRYRGVRKRPWGRYAAEIRDPGKKSRVWLGTFDTAEEAARAYDAAAREFRGAKAKTNFPSPXDLAAAAXTTANRSPSQSSTVESSSREALSPGAIAGPPALDLNLSHPAAAGQFSAVRYPAVGVFPIAQPLFFFEPFSRPEKPKTHRDMFDLDRAVADFHPAIAGSVHSDSDSSSVVDFNYHDRSTRLLNLDLNHPPAEVA

SEQ ID NO: 14 - protein, 258 aa, Jatropha curcas
  misc_feature (29)..(80): Pfam Name: AP2 Pfam Description: AP2 domain
  misc_feature: Public GI ID no. 67906426
  misc_feature: Bit score of 587.1 for HMM based on sequences of Figure 4
  misc_feature: Functional Homolog Of SEQ ID NO. 1
MESKNRKWLQERSNSTGNNLNQNSNTAETRYRGVRKRPWGRYAAEIRDPGKKTRVWLGTFDTAEEAARAYDAAAREFRGSKAKTNFPTVTELNNAAAAAVAAGAVTVARSPSQSSTVESSSPTPPRAASPPPPLDLTLNIPSHQHHHLRHGHFPTGVIFPGGAWISLAAEAHPVFFFDAFSVQGESNNNNKNNIINNNKIHSKNINLCRLDRTVMVSSGVHSDSDSSSVVVDYDHDRSPCNKGLSLDLDLNFPPAEVA

SEQ ID NO: 15 - protein, 225 aa, Nicotiana tabacum
  misc_feature (25)..(76): Pfam Name: AP2 Pfam Description: AP2 domain
  misc_feature: Public GI ID no. 57012757
  misc_feature: Bit score of 527.9 for HMM based on sequences of Figure 4
  misc_feature: Functional Homolog Of SEQ ID NO. 1
MAVKNKVSNGNLKGGNVKTDGVKEVHYRGVRKRPWGRYAAEIRDPGKKSRVWLGTFDTAEEAAKAYDTAAREFRGPKAKTNFPSPTENQSPSHSSTVESSSGENGVHAPPHAPLELDLTRRLGSVAADGGDNCRRSGEVGYPIFHQQPTVAVLPNGQPVLLFDSLWRAGVVNRPQPYHVTPMGFNGVNAGVGPTVSDSSSAVEENQYDGKRGIDLDLNLAPPMEF

SEQ ID NO: 16 - protein, 235 aa, Oryza sativa subsp. indica
  misc_feature (32)..(83): Pfam Name: AP2 Pfam Description: AP2 domain
  misc_feature: Public GI ID no. 56567583
  misc_feature: Bit score of 545.8 for HMM based on sequences of Figure 4
  misc_feature: Functional Homolog Of SEQ ID NO. 1
MAPRAATVEKVAVAPPTGLGLGVGGGVGAGGPHYRGVRKRPWGRYAAEIRDPAKKSRVWLGTYDTAEEAARAYDAAAREFRGAKAKTNFPFASQSMVGCGGSPSSNSTVDTGGGGVQTPMRAMPLPPTLDLDLFHRAAAVTAVAGTGVRFPFRGYPVARPATHPYFFYEQAAAVAAAEAGYRMMKLAPPVTVAAVAQSDSDSSSVVDLAPSPPAVTANKAAAFDLDLNRPPPVEN

SEQ ID NO: 17 - protein, 246 aa, Triticum aestivum
  misc_feature (32)..(83): Pfam Name: AP2 Pfam Description: AP2 domain
  misc_feature: Public GI ID no. 84795246
  misc_feature: Bit score of 560.2 for HMM based on sequences of Figure 4
  misc_feature: Functional Homolog Of SEQ ID NO. 1
MAPRAAEKAPVSPPTGLGLGVGGGIGVVAGGAHYRGVRKRPWGRYAAEIRDPAKKSRVWLGTYDTAEEAARAYDTAAREFRGAKAKTNFPFPSSSLSPVAAAGGGGGSPSSDSTLDSSGGGSGGCAQAPMQAIPLPPALDLDLFHRAAVVTAVAGGGMRFPFNGYPVAPRQPMHPYFFYEQAAAAAAAASGYRALKVAQPVTVAAVARSDSDSSSVVDLSPSPPAVTAHKAVAFDLDLNRPPPSED

SEQ ID NO: 18 - protein, 247 aa, Triticum aestivum
  misc_feature (32)..(83): Pfam Name: AP2 Pfam Description: AP2 domain
  misc_feature: Public GI ID no. 84795248
  misc_feature: Bit score of 552.7 for HMM based on sequences of Figure 4
  misc_feature: Functional Homolog Of SEQ ID NO. 1
MAPRAAEKAPVSPPTGLGLGVGGGIGVVAGGAHYRGVRKRPWGRYAAEIRDPAKKSRVWLGTYDTAEEAARAYDTAAREFRGAKAKTNFPFPSSSLSPVAAAGGGGGSPSSDSTLDSSGGGSGGCAQAPMQAIPLPPALDLDLFHRAAVVTAVAGGGMRFPFNGYPVAPRQPLHPYFFYEQAAAAAAASASGYRALKVAQPVTVAAVAQSDSDSSSVVDLSPSPPAVTAHKAVAFDLDLNRPPPSED

SEQ ID NO: 19 - DNA, 1072 bp, Panicum virgatum
  misc_feature: Ceres Clone ID no. 1805203
  misc_feature: Encodes the peptide sequence at SEQ ID NO. 20
ataccccacacacacccccaccctctctgccctgagctcttcgccgaaccggaacgcccgcacacccacgccacttgtacaccatggcgccccgggcggcgcacaagtcgccggtgccgccggccaccggcctcggtctcggcgtcgtcggtggcgtgggcatgggcccgcacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcggctgcggcgtccaggcgcctatgctggccatgccgctgcccccggccctcgatctcgatctcttccgccgggcggcggccgtgaccgcggtctcccccggcggcatgcggtttcccttcaaagggtaccctgtcgcgcgcccgaccccgaacccctacttctacgaacaggtggccgcggccgccgccgcggcgtccggctaccggatgctcaaggtcgccccgccgccggtcaccgcggccgccgtcgcgcagagcgactccgactcctcgtcggtggtcgatcacaccccttcgccgcccgcggttaccgcgaagaaggaggtctccttcgatctggatctgaactggccgccgccggcggagaactagccacaccagagtttttagctgacgacttcgtagtttctctttcctttttgcctcgaggaatattacttctgttgtttttttggtcctctagcctgtagtttttgttcagtagcctgcgagagacggaggagcctgtgtaaatagtttttccgccgagggcggaattgatctgagatctgttcgtctgtctagacagatcaaaccggcgctgatatggagtaaattatgtactactagtatttcattccattagcatcaagcggatattattattc

SEQ ID NO: 20 - protein, 237 aa, Panicum virgatum
  misc_feature (29)..(80): Pfam Name: AP2 Pfam Description: AP2 domain
  misc_feature: Ceres Clone ID no. 1805203
  misc_feature: Bit score of 558.6 for HMM based on sequences of Figure 4
  misc_feature: Functional Homolog Of SEQ ID NO. 1
MAPRAAHKSPVPPATGLGLGVVGGVGMGPHFRGVRKRPWGRYAAEIRDPAKKSRVWLGTYDTAEEAARAYDAAAREFRGAKAKTNFPFASKCPVAAGAGSPSSNSTVESGGGGGGCGVQAPMLAMPLPPALDLDLFRRAAAVTAVSPGGMRFPFKGYPVARPTPNPYFYEQVAAAAAAASGYRMLKVAPPPVTAAAVAQSDSDSSSVVDHTPSPPAVTAKKEVSFDLDLNWPPPAEN

SEQ ID NO: 21 - DNA, 864 bp, Zea mays
  misc_feature: Ceres Clone ID no. 101497672
  misc_feature: Encodes the peptide sequence at SEQ ID NO. 22
tcgctgtaccagaagacccgcacacacacgccacttgtattaccatggcgccccgggtggcggacaagtcgccgctaccgccggccaccggcctggggctgggcgttggcggaggagtcgggggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccgttgctgccggtagcgctagtagcaacagcaccgtggattcgagcggtggcggtagcggctgtggcatccaggcgcctatgcaggccatgccgcttcctccggctytcgatctcgrcctcttccatcgggcggccgccgtgaacgcagtctcccccggcatgcggtttccgttcaagggctatcctgtcgcctgcccgacgccccagcagtactttttctacgagcaggcagcggccgcggctgccgcggcatccggataccggatgctcaaggtcgctcccccggccgtgactgtggccgcggttgcgcagagcgactccgactcgtcgtctgtggttgatcactccccttcgcctcccgcggtgacggaaaacaaggtgggcttcgaactggatctgaactggcccccgccggcagagaactaggcaggccggagtttttggctgacgacttagtagcttctttttcccttttgccttcatcaggaatgttacttgtggttgtttggtcctgtatggctgt

SEQ ID NO: 22 - protein, 240 aa, Zea mays
  misc_feature (32)..(83): Pfam Name: AP2 Pfam Description: AP2 domain
  misc_feature: Ceres Clone ID no. 101497672
  misc_feature: Bit score of 569.4 for HMM based on sequences of Figure 4
  misc_feature: Functional Homolog Of SEQ ID NO. 1
  misc_feature (135)..(135): Xaa is any aa, unknown, or other
  misc_feature (138)..(138): Xaa is any aa, unknown, or other
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASVAAGSASSNSTVDSSGGGSGCGIQAPMQAMPLPPAXDLXLFHRAAAVNAVSPGMRFPFKGYPVACPTPQQYFFYEQAAAAAAAASGYRMLKVAPPAVTVAAVAQSDSDSSSVVDHSPSPPAVTENKVGFELDLNWPPPAEN

SEQ ID NO: 23 - DNA, 1059 bp, Zea mays
  misc_feature: Ceres Clone ID no. 224845
  misc_feature: Encodes the peptide sequence at SEQ ID NO. 24
ctagacgccacacacacacatcgcttctccacacgacctcgctgaaccggaagacccgcacacacacgccacttgtgcaccatggcgccccgggtggcggacaagtcgccattgccgctggccaccggcctgaagctgggcgtaggcggaggcatgggcctgggtccacactaccgaggcgtgaggaagcggccgtggggacgttacgccgcggagatccgcgacccagccaagaagagtcgcgtgtggctgggcacgtacgacacggccgaggaggccgccaaggcctacgacgtcgccgcccgcgagttccgtggcgccaaggccaagactaacttcccgttccccctcgccgtcgccgtcgccgtcgccggcggtgctggtagccccagcagcgacagcaccaccttggaatcgagctgtggcggcagcgggtgtggcgtcgaagcgcctgtgcaggcggccatgccgctgaccccggccctcgacctcgatctcttccaccgggcggccgccgtcagcgcggtcaccaccggcggcatgccctttccgttcaaggccttccccgtcgtgcgcccgaccccacatcagtacttcctctacaatcaggccgcggcggccgcggcagccgggtacaggatggtcaaggtcgcctcagctccagtcaccgtagccgccgtcgcgcagagcgactccgactcctcgtctgtggttgatcgcacctgttcgcctcccgcggtgacggcaaagaaggaggtcagcttcgaactggatctgaactggccgccgccggcagagaactagtcgcaccggagttttcagctgacgactttgcagtttcctttttcccttttggccttcatcaggaattgtagtgtagctctgggtgtttggtcttttttttttcttgcatgtagagtgtagactatgatatggtggagccttgtacatagtactgtagtgttttttttttccgccgagacggagtagatctgttcgtgtgtctggacagatcaaaccggcgttgatatgggctttaaaccatggagcatgttgatt

SEQ ID NO: 24 - protein, 240 aa, Zea mays
  misc_feature (29)..(80): Pfam Name: AP2 Pfam Description: AP2 domain
  misc_feature: Ceres Clone ID no. 224845
  misc_feature: Bit score of 487.2 for HMM based on sequences of Figure 4
  misc_feature: Functional Homolog Of SEQ ID NO. 1
MAPRVADKSPLPLATGLKLGVGGGMGLGPHYRGVRKRPWGRYAAEIRDPAKKSRVWLGTYDTAEEAAKAYDVAAREFRGAKAKTNFPFPLAVAVAVAGGAGSPSSDSTTLESSCGGSGCGVEAPVQAAMPLTPALDLDLFHRAAAVSAVTTGGMPFPFKAFPVVRPTPHQYFLYNQAAAAAAAGYRMVKVASAPVTVAAVAQSDSDSSSVVDRTCSPPAVTAKKEVSFELDLNWPPPAEN

SEQ ID NO: 25 - protein, 236 aa, Oryza sativa subsp. japonica
  misc_feature (36)..(87): Pfam Name: AP2 Pfam Description: AP2 domain
  misc_feature: Public GI ID no. 115464685
  misc_feature: Bit score of 429.0 for HMM based on sequences of Figure 4
  misc_feature: Functional Homolog Of SEQ ID NO. 1
MAPRTSDKTMSPAAAATGLALGVGGVAGAAAVGTGQHFRGVRKRPWGRYAAEIRDPAKKSRVWLGTFDTAEEAARAYDAAAREYRGAKAKTNFPYPNGAPAAGVNSGSSNSSTVESFGSDVQAPMKAMPIPPSLELDLFHRAAAAAAAGAGGMRFPFEGYPVSHPYYFFGQAAAAAAASGCRMLKIAPAPVTVAALAQSDSDSSSIVDLAPSPPAALAKKAIAFDLDLNCPPPMEV

SEQ ID NO: 26 - DNA, 1065 bp, Zea mays
  misc_feature: Ceres Clone ID no. 1287030
  misc_feature: Encodes the peptide sequence at SEQ ID NO. 27
aaaaatcccagacgccacgccacccaacacatacaaacacacgcacgcgcgcgcgcgcgcctcccgctgttccgcaaaacaaaggaaacgaaggagaggaggccatggcgccgagaacgtcagagaaaaccatggcaccggcggcggccgctgccacggggctcgcgctcagcgtcggcggcggcggcggggccggcggcccgcactacagaggcgtgaggaagcggccgtggggccggtacgcggcggagatccgcgacccggcgaagaagagccgggtgtggctcggcacctacgacacggccgaggacgccgcgcgggcctacgacgccgccgcgcgcgagtaccgcggcgccaaggccaagaccaacttcccttacccctcgtgcgtgcccctctccgcagccggttgccggagcagcaacagcagcaccgtcgagtccttcagcagcgacgcgcaggcgcccatgcaggccatgccgctcccgccgtcgctcgagctggacctgttccaccgcgcggcggccgcggccacgggcacgggcgctgccgccgtacgcttccctttcggcagcatccccgttacgcacccgtactacttcttcgggcaggccgcagccgcagccgcggaagcagggtgccgtgtgctcaagctggcgccggcggtcaccgtggcgcagagcgactccgactgttcgtcggtagtggatctgtcgccgtcgccaccggccgctgtgtcggcgaggaagcccgccgcgttcgatctcgacctgaactgctcaccgccgacggaggcggaagcctagtcgtcgaagcttttaatgactgtctgtcttcttagttctttcttctcctttttctcgaggaaaattcggtactactaagctgagagacgctctcctccgacagacgacgtcgacgacgggcatttttgtaaatagtttttgcgccgggacctttttagtttatgatgaaagctgtattgtcaccgaagacaggtcctgccggcgttgttatggaccggattactatattatattatgcactactagtattttgatagcc

SEQ ID NO: 27 - protein, 233 aa, Zea mays
  misc_feature (33)..(84): Pfam Name: AP2 Pfam Description: AP2 domain
  misc_feature: Ceres Clone ID no. 1287030
  misc_feature: Bit score of 386.2 for HMM based on sequences of Figure 4
  misc_feature: Functional Homolog Of SEQ ID NO. 1
MAPRTSEKTMAPAAAAATGLALSVGGGGGAGGPHYRGVRKRPWGRYAAEIRDPAKKSRVWLGTYDTAEDAARAYDAAAREYRGAKAKTNFPYPSCVPLSAAGCRSSNSSTVESFSSDAQAPMQAMPLPPSLELDLFHRAAAAATGTGAAAVRFPFGSIPVTHPYYFFGQAAAAAAEAGCRVLKLAPAVTVAQSDSDCSSVVDLSPSPPAAVSARKPAAFDLDLNCSPPTEAEA

SEQ ID NO: 28 - DNA, 774 bp, Sorghum bicolor
  misc_feature: Ceres Annot ID no. 8733383
  misc_feature: Encodes the peptide sequence at SEQ ID NO. 29
atggcgccgagaacgtcagagaaaacgatgacaccggcggcggcggctgccgccacggggctcgcgcttagcgtcagcggcggagccggagccagcggcccgcacttcagaggcgtcaggaagcggccgtggggccggtacgccgcggagatccgcgacccggccaagaagagccgcgtgtggctcggcacgttcgacacggccgaggaggctgcgcgggcctacgacgccgccgcgcgcgactaccgcggcccaaaggccaagaccaacttccctttcccttcgtcgtgcatgccactcgccgccggcgccggcgccggcagcttgcctgcggcgaaggccgtcaccggtggcggcggcagccggagcagcaacagcagcaccgtcgagtctttcagcagcggcagcgacgtgcaggcggcgcccatgcaggccatgccgctcccaccgtctctggagctcgacctgttccaccgcgcggcggctgcgggcacgggcacgggcggcgccgccgtacggttccctttcaacagctaccccgtgacgcacccgtactatttcttcgggcaggccgctgctgccgcggcggcagggtgccacatgctcaagctggcaccgacggtgaccgtggcggccgtggcgcagagcgactccgactcctcgtcggtcgtggatctgtcgccatcgccgccggccgccgtgtcgacgcagaaggccgccgccgcgttcgatcttgacctgaactgcccaccgccggcggagatggaggcctag

SEQ ID NO: 29 - protein, 257 aa, Sorghum bicolor
  misc_feature (34)..(85): Pfam Name: AP2 Pfam Description: AP2 domain
  misc_feature: Ceres Annot ID no. 8733383
  misc_feature: Bit score of 425.4 for HMM based on sequences of Figure 4
  misc_feature: Functional Homolog Of SEQ ID NO. 1
MAPRTSEKTMTPAAAAAATGLALSVSGGAGASGPHFRGVRKRPWGRYAAEIRDPAKKSRVWLGTFDTAEEAARAYDAAARDYRGPKAKTNFPFPSSCMPLAAGAGAGSLPAAKAVTGGGGSRSSNSSTVESFSSGSDVQAAPMQAMPLPPSLELDLFHRAAAAGTGTGGAAVRFPFNSYPVTHPYYFFGQAAAAAAAGCHMLKLAPTVTVAAVAQSDSDSSSVVDLSPSPPAAVSTQKAAAAFDLDLNCPPPAEMEA

SEQ ID NO: 30 - protein, 236 aa, Triticum aestivum
  misc_feature (36)..(87): Pfam Name: AP2 Pfam Description: AP2 domain
  misc_feature: Public GI ID no. 84795240
  misc_feature: Bit score of 405.9 for HMM based on sequences of Figure 4
  misc_feature: Functional Homolog Of SEQ ID NO. 1
MAPRTSDKTATPPAAGAAATGLALGVGGGNGGGVGPHYRGVRKRPWGRYAAEIRDPAKKSRVWLGTYDTAEEAARAYDAAAREYRGNKAKTNFPFATASAPPAAAAALTVDGSRSSNSSTVESFGGDVQAPMQAMPLPPSLDLDLFHRAATSTAGAGMRFPFSGYPVSHPYYFFGQAAAAAAAGCHMYSQAPKVTVASVSPSDSDSSSVVDLAPSPPARKPVPFELDLNCPPPAEL

SEQ ID NO: 31 - DNA, 1048 bp, Panicum virgatum
  misc_feature: Ceres Clone ID no. 1806017
  misc_feature: Encodes the peptide sequence at SEQ ID NO. 32
aagcctagacgccaccccctcctcccctacacacacgccgcaggcgcgcgcctcccgcacaaaggaaaagaacgaggccatggcgccgagaacgtcggagaaaacgatggcaccggcggcgtccccggggctcgcgctcggcgtcggcggcggcggcggcccgcacttccgcggcgtcaggaagcgcccgtggggccggttcgcggcggagatccgcgacccggccaagaagagccgcttgtggctcggcacgttcgacacggccgaggaggccgcgcgggcctacgacgccgccgcgcgcgagtaccgcggcgccaaggccaagaccaacttcccctacccttcgtcggcgtccgtgcccccggccgccaccgccggcagccggagcggcgacagcagcaccgtggagtccttcggcggcgacgtgcaggcgcccatgcaggccatgccgctgccgccgtcgctcgagctggacctgttccaccgcgcggcggccgcgggcgccggcgccggcgtgcgcttcccgttcagcggctaccccgtgacgcacccctactacatcttcagccaggccgccgcggccgccgccgcggggtgccacatgcagctgaagctgccgccgacggtgaccgtggcggccgtggtgcaaagcgactccgactcctcgtcggtcgtggacctgtcgccgccgccgctcgccgccgccgggtcggcgaagaaggcctccgcgttcgatctcgatctgaactccccgccgccggcggaggcggaggcctagtagccggagtttagctgatgactggcactagttcctttcttcgtttcttccttcgcctttttcccctagaagaaacttggctgtatgtttacgcgtaggccctctctcttaccagaccagagagggaggacatttttgtaaatagtttttccgccggggatctaagctctagctgatgataaaaaaaaaagctgtattgtcatccaagacaggtcctgccggcgttgtcatggaccggattatattaattaattaagtgttttgatagtc

SEQ ID NO: 32 - protein, 232 aa, Panicum virgatum
  misc_feature (28)..(79): Pfam Name: AP2 Pfam Description: AP2 domain
  misc_feature: Ceres Clone ID no. 1806017
  misc_feature: Bit score of 405.8 for HMM based on sequences of Figure 4
  misc_feature: Functional Homolog Of SEQ ID NO. 1
MAPRTSEKTMAPAASPGLALGVGGGGGPHFRGVRKRPWGRFAAEIRDPAKKSRLWLGTFDTAEEAARAYDAAAREYRGAKAKTNFPYPSSASVPPAATAGSRSGDSSTVESFGGDVQAPMQAMPLPPSLELDLFHRAAAAGAGAGVRFPFSGYPVTHPYYIFSQAAAAAAAGCHMQLKLPPTVTVAAVVQSDSDSSSVVDLSPPPLAAAGSAKKASAFDLDLNSPPPAEAEA

SEQ ID NO: 33 - protein, 236 aa, Triticum aestivum
  misc_feature (36)..(87): Pfam Name: AP2 Pfam Description: AP2 domain
  misc_feature: Public GI ID no. 84795242
  misc_feature: Bit score of 404.0 for HMM based on sequences of Figure 4
  misc_feature: Functional Homolog Of SEQ ID NO. 1
MAPRTSDKTATPPAAGAAATGLALGVGGGNGGGVGTHYRGVRKRPWGRYAAEIRDPAKKSRVWLGTYDTAEEAARAYDAAAREYRGNKAKTNFPFASASAPPAAAAALTGDGSRSSNSSTVESFGGDVQAPMQAMPLPPSLELDLFHRAATSTAGAGMRFPFSGYPVSHPYYFFGQAAAAAAAGCHMYSQAPKVTVASVSPSDSDSSSVVDLAPSPPTRKPVPFDLDLNCPPPAEL

SEQ ID NO: 34 - protein, 240 aa, Triticum aestivum
  misc_feature (37)..(88): Pfam Name: AP2 Pfam Description: AP2 domain
  misc_feature: Public GI ID no. 84795238
  misc_feature: Bit score of 404.4 for HMM based on sequences of Figure 4
  misc_feature: Functional Homolog Of SEQ ID NO. 1
MAPRTSDKTATPPAAGAAATGLALGVGGGGNGGGVGPHYRGVRKRPWGRYAAEIRDPAKKSRVWLGTYDTAEEAARAYDAAAREYRGNKAKTNFPFASASAPPAAAALTGDGSRSSNSSTVESFGGDVQAPMQAMPLPPSLELDLFHRAATSTAGAGAGAGMRFPFSGYPVSHPYYFFGQAAAAAAGGCHMYSQAPKVTVASVSPSDSDSSSVVDLAPSPPSRKPVPFDLDLNCPPPAEL

SEQ ID NO: 35 - DNA, 778 bp, Musa acuminata
  misc_feature: Ceres Clone ID no. 1733772
  misc_feature: Encodes the peptide sequence at SEQ ID NO. 36
gagaaagtagagagagaagacggactccttgctgtggcgctacgagagaacccgatggccggcggcggtgggagagctggcggtggaggaagagcaggggggaaggagacccattaccgaggggtgaggaagcggccttgggggaggtacgctgcggagatacgggacccggggaagaagagccgggtctggctcgggacctttgacacggccgaggaggccgcgcgggcatacgatgccgccgcccggcagttccgtggatccaaggccaagaccaacttcccccacccggaggcgtacacgaggccgggcccggccggagtcgtcgcgatcgcgaccccggcggcgggtggcggcagccccagcagccagagcagcacggtggagtcctccagccgcgaggtgccgccactcgcgatccctctcccgccctcgctcgactttgatctcctccgccgccgcgtcgcgcggttcccattccagccctaccccgcggtcgccgccccagccatgccggcatcccgcccgtgctgcctcttcgacacgatcgtcggatccgagaaggcgtcggcggcggtgtccatgaaccgccgccgcttttgcccgtccatgatcatcgccgatatgcacgctccaacggccagcggcgttttgagcgattccgactcctactccgtcgccgacgtgcgcctcaaccaccgcttccgggggccgcacaagatgctgacgctcgatttagatctcaacctgccccctccacccgagatcgcctgatgtg

SEQ ID NO: 36 - protein, 239 aa, Musa acuminata
  misc_feature (19)..(70): Pfam Name: AP2 Pfam Description: AP2 domain
  misc_feature: Ceres Clone ID no. 1733772
  misc_feature: Bit score of 341.7 for HMM based on sequences of Figure 4
  misc_feature: Functional Homolog Of SEQ ID NO. 1
MAGGGGRAGGGGRAGGKETHYRGVRKRPWGRYAAEIRDPGKKSRVWLGTFDTAEEAARAYDAAARQFRGSKAKTNFPHPEAYTRPGPAGVVAIATPAAGGGSPSSQSSTVESSSREVPPLAIPLPPSLDFDLLRRRVARFPFQPYPAVAAPAMPASRPCCLFDTIVGSEKASAAVSMNRRRFCPSMIIADMHAPTASGVLSDSDSYSVADVRLNHRFRGPHKMLTLDLDLNLPPPPEIA

SEQ ID NO: 37 - protein, 220 aa, Vitis aestivalis
  misc_feature (20)..(71): Pfam Name: AP2 Pfam Description: AP2 domain
  misc_feature: Public GI ID no. 37625037
  misc_feature: Bit score of 513.7 for HMM based on sequences of Figure 4
  misc_feature: Functional Homolog Of SEQ ID NO. 1
MAPRDKPTGVTAGATGNKEIRYRGVRKRPWGRYAAEIRDPGKKSRVWLGTFDTAEEAARAYDAAAREFRGAKAKTNFPSPTDLAAAAATTANRSPSQSSTVESSSREALSPGAIAGPPALDLNLSHPAAAGQFSAVRYPAVGVFPIAQPLFFFEPFSRPEKPKTHRDMFDLDRAVADFHPAIAGSVHSDSDSSSVVDFNYHDRSTRLLNLDLNHPPAEVA

SEQ ID NO: 38 - protein, 249 aa, Vitis aestivalis
  misc_feature (19)..(70): Pfam Name: AP2 Pfam Description: AP2 domain
  misc_feature: Public GI ID no. 37625035
  misc_feature: Bit score of 392.3 for HMM based on sequences of Figure 4
  misc_feature: Functional Homolog Of SEQ ID NO. 1
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGVGVGVGVGAAAGYATAMRFPFQHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 39 - protein, 249 aa, Vitis vinifera
  misc_feature (19)..(70): Pfam Name: AP2 Pfam Description: AP2 domain
  misc_feature: Public GI ID no. 147805535
  misc_feature: Bit score of 389.4 for HMM based on sequences of Figure 4
  misc_feature: Functional Homolog Of SEQ ID NO. 1
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGVGVGVGVGAAAGYATALRFPFQHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 40 - protein, 227 aa, Vitis vinifera
  misc_feature (19)..(70): Pfam Name: AP2 Pfam Description: AP2 domain
  misc_feature: Public GI ID no. 157358724
  misc_feature: Bit score of 387.3 for HMM based on sequences of Figure 4
  misc_feature: Functional Homolog Of SEQ ID NO. 1
MAPKEKVAGVKPSANAKEVHFRGVRKRPWGRYAAEIRDPGKKSRVWLGTFDTAEEAAKAYDSAAREFRGAKAKTNFPLVSENLNNNNQSPSQSSTVESSSREGFSPALMVDSSPLDLNLLHGGGVGHHQFQVSSPSPAAGIVPTGGLPAANHLFYFDAMLRTGRVNQDFQRLRFDRAASDFRAALTGGVQSDSDSSSVVDLNHNDLKPRARVLIDLDLNRPPPPEIA

SEQ ID NO: 41 - protein, 238 aa, Stylosanthes hamata
  misc_feature (23)..(74): Pfam Name: AP2 Pfam Description: AP2 domain
  misc_feature: Public GI ID no. 4099914
  misc_feature: Bit score of 486.6 for HMM based on sequences of Figure 4
  misc_feature: Functional Homolog Of SEQ ID NO. 1
MAPREKTPAVKVNGKSNAGVKEVHFRGVRKRPWGRYAAEIRDPGKKSRVWLGTFDTAEDAARAYDAAAREFRGPKAKTNFPFPDSDDINNNNIVVVKNNNRSPSQSSTVESSSRDRDSYSAAAATAVADSSPLDLNLAPQELDSPDPFGSHSTQPFAVFPGGMPAAKQALYLDAVLRASMASHGQFGFGYNRPAAAGAQSDSDSSSVIDLNQNEGDVAKNNGRGLVLDLNEPPPQEMA

SEQ ID NO: 42 - DNA, 681 bp, Populus balsamifera subsp. trichocarpa
  misc_feature: Ceres Annot ID no. 1520029
  misc_feature: Encodes the peptide sequence at SEQ ID NO. 43
atggctcctagagaaagatctaacaacaacaacagcccgaacagccctagatcggagatccgttttagaggcgtcaggaagagaccatggggacgttatgcagctgagatcagagacccaggcaagaaaacgagggtttggctgggcacttttgatactgctgaagaggccgcccgtgcatacgatgcggctgctcgtgaattccgcggagccaaagccaaaactaatttccctacaatcggcgagcttaatcccaaccccacgcgcagtcctagccaaagcagcactgtcgagtcctcctccccaccgcccccacgcgccgcttctcctccaccaccactcgacctcactcttaacatttcccgccataaacccgaccgccagccttttcccaatggagttagttttccaggaggcgcgtggtttccattccctgctgttgcgcgtcccgttttcttcttcgacgcgtttgctcacgcgaagaatgatattcctaacaataatagtatagtgaataatattaacatgtgcaggtttgatcgaacggtgatggtgaatggaggtggggcccagagtgattcggattcatcatcagtcgtcgattacgatcatcgtcgtgatagtaagggattgtcacttgatcttgatcttaacctggccccaccaccggaagtctcgtga

SEQ ID NO: 43 - protein, 226 aa, Populus balsamifera subsp. trichocarpa
  misc_feature (20)..(71): Pfam Name: AP2 Pfam Description: AP2 domain
  misc_feature: Ceres Annot ID no. 1520029
  misc_feature: Bit score of 366.0 for HMM based on sequences of Figure 4
  misc_feature: Functional Homolog Of SEQ ID NO. 1
MAPRERSNNNNSPNSPRSEIRFRGVRKRPWGRYAAEIRDPGKKTRVWLGTFDTAEEAARAYDAAAREFRGAKAKTNFPTIGELNPNPTRSPSQSSTVESSSPPPPRAASPPPPLDLTLNISRHKPDRQPFPNGVSFPGGAWFPFPAVARPVFFFDAFAHAKNDIPNNNSIVNNINMCRFDRTVMVNGGGAQSDSDSSSVVDYDHRRDSKGLSLDLDLNLAPPPEVS

SEQ ID NO: 44 - DNA, 983 bp, Zea mays
  misc_feature: Ceres Clone ID no. 1065091
  misc_feature: Encodes the peptide sequence at SEQ ID NO. 45
aattatcacaccactctctccctctcctcctttatattttagttatggccaagattggtttgaaacccgatccagttaacaataatgccaaggagattcgttacagaggcgttaggaagaggccatggggccgttatgccgcggagatccgagatccgggtaagaaaacccgggtctggcttggtactttcgataccgccgaagaggcggcgcgtgcttacgatgcggcggcgcgtgatttccgaggggccaaggctaagaccaatttccccaattttctcgagctgagtgagaagatgccggctgccggcggcggtttcgagcgtagcccaagccagagcagcacccttgactgcgattctcctccggcggcggttacgccggcgagtgctgggattgttccgccgcagctcgagcttcgcctcggcggctatcagatcccgatggcgcgtcctatttactttttggacgttatgggagtaggcaacggaggtcgtgctcagcctccggtggcgtcagcttttaggtcgccggtggcttgtgtggctcagagcgactctgattcgtcgtcggttgttgatttcgaaggtgtgatggagaagagatctcagctgtttgatctagatctaaacttgtctcctccgtcggaacaggcctgaacttatcgaaggtggtcgtggtcgtgttcatttccgacgcgcatgcgttttttttttgtttgggagctgagagaattcgtattctcgttagttttttattctctctcactctagaataattattattatcggtttaaaaaaaaaaagtttatcgggagagagaatataattttagctgacatggatcgttatgtacatattattacataactggagatctgaacttttgttgtgtgcttttttgcgacttggtttcaccttgttgttcctctatctgtagcctttaattttgttattgcaaattttatatcaataatttggtga

SEQ ID NO: 45 - protein, 204 aa, Zea mays
  misc_feature (18)..(69): Pfam Name: AP2 Pfam Description: AP2 domain
  misc_feature: Ceres Clone ID no. 1065091
  misc_feature: Bit score of 263.9 for HMM based on sequences of Figure 4
  misc_feature: Functional Homolog Of SEQ ID NO. 1
MAKIGLKPDPVNNNAKEIRYRGVRKRPWGRYAAEIRDPGKKTRVWLGTFDTAEEAARAYDAAARDFRGAKAKTNFPNFLELSEKMPAAGGGFERSPSQSSTLDCDSPPAAVTPASAGIVPPQLELRLGGYQIPMARPIYFLDVMGVGNGGRAQPPVASAFRSPVACVAQSDSDSSSVVDFEGVMEKRSQLFDLDLNLSPPSEQA

SEQ ID NO: 46 - DNA, 1144 bp, Gossypium hirsutum
  misc_feature: Ceres Clone ID no. 1793792
  misc_feature: Encodes the peptide sequence at SEQ ID NO. 47
atctcaaccccacacataaatacccttttaccaaaggagaacattaaaacatagcccaactcttcgttttcttcaagcggaaaacagaaaactgaggctttcccttctcaaatggcaccgagggagaaaacggcggccgtcaagggtactgggaataataacgaggttcatttcagaggagtaaggaagcgtccatgggggcgttacgctgctgagatcagagatccagggaagaagagccgtgtttggctaggaacctttgatacggccgaggaagcagccagagcctacgacgccgccgctagggaatttcgcggcgccaaggccaagactaattttccggtcccttgtgagaatctcagcaaaggtaataactgtaaaagtaatggtaacaacaaccaccatagccctagccagagtagcaccgtggaatcctcgagccgtgagccggcgctcatggtagactcttcgcctttagatctcaacctcgtacaaggtgaggcggttactggttacgtgcctacggctgttagatttcctttccagcaagcttcaccggtgccatatattgcgggccgcaaagttttctactttgaaccgttcgttcggcctggtgcagtgaaaggacacccatttcaacggtttggattcgatcatcatgatcttcatgcgacgtttaatggtgtacaaagcgactctgactcatcatccgtcgttgatttgaaccaccacgaggtcaagtcgcgcccgcttctcaatatcgatctcaaccaacctgccgtgccggaaattgcctgatttattttttaatattcgcagatcgtcaaagcggaaaggcaaaaaagaaaaacgagttttttaaaatttcgttgtttaaacataactttcttagcagtcccgaggaaatatcgaaggtagattttagagaaaatgagaccccaaaaaaaaaaaaagagataaatttacggcaacagctgtgatattttgatgtgatctatcgtggcaatcgaatggcccagattatgtgtatagttagctcaagaactccttttttgcagcagataaacatcagttttgtctgttgttttaataactaattactgtaatttttccctcctatgaattaagcacaacaagtttcctt

SEQ ID NO: 47 - protein, 228 aa, Gossypium hirsutum
  misc_feature (19)..(70): Pfam Name: AP2 Pfam Description: AP2 domain
  misc_feature: Ceres Clone ID no. 1793792
  misc_feature: Bit score of 366.9 for HMM based on sequences of Figure 4
  misc_feature: Functional Homolog Of SEQ ID NO. 1
MAPREKTAAVKGTGNNNEVHFRGVRKRPWGRYAAEIRDPGKKSRVWLGTFDTAEEAARAYDAAAREFRGAKAKTNFPVPCENLSKGNNCKSNGNNNHHSPSQSSTVESSSREPALMVDSSPLDLNLVQGEAVTGYVPTAVRFPFQQASPVPYIAGRKVFYFEPFVRPGAVKGHPFQRFGFDHHDLHATFNGVQSDSDSSSVVDLNHHEVKSRPLLNIDLNQPAVPEIA

SEQ ID NO: 48 - DNA, 930 bp, Glycine max
  misc_feature: Ceres Clone ID no. 1619220
  misc_feature: Encodes the peptide sequence at SEQ ID NO. 49
gaagcctacatatacagcactactctctgatcagttttttcttggtctccgaatcacaaactcttcgaaaaaactaacattaatggctccgagggatatcaatagatctaacgttgttgttgccggaggatccaacccgacccgtaaagagatccgataccgcggcgtgaggaagcggccgtggggccgctacgccgccgagatccgcgatcccggcaagaagacgcgcgtctggctaggaacgttcgacaccgcggaggaggcggcgcgtgcgtacgatgcggcggcgcgtgagttccgcggcgcaaaggctaagaccaatttccccacccacgcggagctgacgcacgcggcggcgcgtagccccagccagagcagcacgttggattcgtcctctcccccgacgccgccgttggacctcactcttgccgccccactcgccgccggtggcgcgttggtgttcccagtggcgcggcccgtggtcttcttcgacgcgttcgagcgtgccgaggtgcgcgcgtcgttcgatcttcccgtggcggcgttcagcgactcggactcgtccacggtcatggattacgagcggggctcacgtcggagagtgttggatcttgaccttaatgtccctcctccgcccgaggttgcctgaaccggaaaaaagatccggttttttcgcagctcggtttttctctctctatctgagtgagtggcgattatcaatttatcgtagtagctgacacggtgctagagtttatgtaaatatattataaatagattacaattaaccaaaccaaaaagaaaaagcaggcttatgtttttttttctctattctgcttttttttttccttttcgcaaaggaagaaggaatttcttacctcactgttgcccggtgatgttaactttttatatatataatgccatttctatatc

SEQ ID NO: 49 - protein, 188 aa, Glycine max
  misc_feature (24)..(75): Pfam Name: AP2 Pfam Description: AP2 domain
  misc_feature: Ceres Clone ID no. 1619220
  misc_feature: Bit score of 283.9 for HMM based on sequences of Figure 4
  misc_feature: Functional Homolog Of SEQ ID NO. 1
MAPRDINRSNVVVAGGSNPTRKEIRYRGVRKRPWGRYAAEIRDPGKKTRVWLGTFDTAEEAARAYDAAAREFRGAKAKTNFPTHAELTHAAARSPSQSSTLDSSSPPTPPLDLTLAAPLAAGGALVFPVARPVVFFDAFERAEVRASFDLPVAAFSDSDSSTVMDYERGSRRRVLDLDLNVPPPPEVA

SEQ ID NO: 50 - protein, 227 aa, Nicotiana sylvestris
  misc_feature (25)..(76): Pfam Name: AP2 Pfam Description: AP2 domain
  misc_feature: Public GI ID no. 57012875
  misc_feature: Bit score of 505.6 for HMM based on sequences of Figure 4
  misc_feature: Functional Homolog Of SEQ ID NO. 1
MAVKNKVSNGDLKGGNVKTNGVKEVHYRGVRKRPWGRYAAEIRDPGKKSRVWLGTFDTAEEAAKAYDTAAREFRGPKAKTNFPLPSENQSTSHSSTMESSSGETGIHAPPHAPLELDLTRRLGSVAADGGDNCRRSGEVGYPIFHQQPTVAVLPNGQPVLLFDSLWRPGVVNRPQPYHVMPMAMGFNGVNAGVDPTVSDSSSVVEENQYDGKRGIDLDLNLAPPTEF

SEQ ID NO: 51 - protein, 211 aa, Vitis vinifera
  misc_feature (16)..(67): Pfam Name: AP2 Pfam Description: AP2 domain
  misc_feature: Public GI ID no. 147811787
  misc_feature: Bit score of 301.8 for HMM based on sequences of Figure 4
  misc_feature: Functional Homolog Of SEQ ID NO. 1
  misc_feature (55)..(55): Xaa is any aa, unknown, or other
MALKEKVKEGVKAKEPHFRGVRKRPWGRYAAEIRDPTKKSRVWLGTFDTAEEAAXAYDAAAREFRGSKAKTNFPLPNEVLPFPNTDNLTRSPSPSSTVESSSPHAPLELDLTRRLGSSDGGFPFHYQPHVVNSAAVAGVWPHARPVLFLDAFVGAEGFRVNPVTVAYDGGFGSPVQSESDSSSVVDSVQHESSGATRVLGLDLNFPPPLEA

SEQ ID NO: 52 - DNA, 1097 bp, Gossypium hirsutum
  misc_feature: Ceres Clone ID no. 1842925
  misc_feature: Encodes the peptide sequence at SEQ ID NO. 53
aacaaataccaacgacaatccccccaccattttttcctctctcaacaaaatttcatcactcttaaacggagcttcctaaatggcgccgagggagaaaacggcggacgtcaagggaaaagggaatgggtgtaataaagaggttcattttagaggagtaaggaagcgtccatggggtcgttacgccgctgagatcagagatccagggaagaaaagccgtgtttggcttggaacttttgatacagctgaggaagcggccaaggcctacgacgccgccgccagagaattccgcggcgccaaggcgaagactaatttccccctccctggtgaaattctcaacaatggtagtaactgtaacaacaatggcgataccaactgcaacaacaacaataacaaccacagccctagccggagtagcaccgtggagtcatcaagccacgagccgccgacactcgtcaagtgttcaccgttggatctcaatctcggacacgctgcggtcaccgggtacggatctcctgcggtcaggcttcctttccctcaaatttcgccggtcgccggttttttcgccaacggcgtctcggcagttgcagccccccaagttttttacttcgacgctttggtccgacccggtgttatgaaaggacagcagtatcaacaacggttgagattcgatcaccgtgattatcacgaaacttttaacgctggtgtacaaagcgactcagattcatcctccgtcgttgatttaaaccaccacgagatcaaacggcgaccgcttctcaatatcgatctcaaccaacctgctccggaagtcgcctgattatgattttttaaaatcgccgatatcaagaaccggaaaagaaaaacccacaaattttcaattttatctctttaaaatcgttaatcttctttttagtcccaattttgaaaattagacgagaaaattatacccaaaaagaaattacgcgagagcggcgtaaattgtgaatacgtagatgaaaaatctcctctttttcgcagcagagtaacgttagtttgttgtctgttgtttcatattaatttctgtaattattttaattttcaatgaattaattagtaattac

SEQ ID NO: 53 - protein, 244 aa, Gossypium hirsutum
  misc_feature (21)..(72): Pfam Name: AP2 Pfam Description: AP2 domain
  misc_feature: Ceres Clone ID no. 1842925
  misc_feature: Bit score of 347.0 for HMM based on sequences of Figure 4
  misc_feature: Functional Homolog Of SEQ ID NO. 1
MAPREKTADVKGKGNGCNKEVHFRGVRKRPWGRYAAEIRDPGKKSRVWLGTFDTAEEAAKAYDAAAREFRGAKAKTNFPLPGEILNNGSNCNNNGDTNCNNNNNNHSPSRSSTVESSSHEPPTLVKCSPLDLNLGHAAVTGYGSPAVRLPFPQISPVAGFFANGVSAVAAPQVFYFDALVRPGVMKGQQYQQRLRFDHRDYHETFNAGVQSDSDSSSVVDLNHHEIKRRPLLNIDLNQPAPEVA

SEQ ID NO: 54 - protein, 195 aa, Thellungiella halophila
  misc_feature (24)..(75): Pfam Name: AP2 Pfam Description: AP2 domain
  misc_feature: Public GI ID no. 20340233
  misc_feature: Bit score of 245.7 for HMM based on sequences of Figure 4
  misc_feature: Functional Homolog Of SEQ ID NO. 1
MTKMGFKPDSNPSPNPNESNAKEIRYRGVRKRPWGRYAAEIRDPGKKTRVWLGTFDTAQQAARAYDAAAREFRGAKAKTNFPTFLELNAAKDGGFARSPSQSSTVDSVSPTSARLVTPPQLELSLGGGGGGACYQIPVARRPVYFYNMTTFPAAAAATCGVQSESDSSSVVDFECGAEKKYRPLDLDLNLAPPAE

SEQ ID NO: 55 - DNA, 898 bp, Glycine max
  misc_feature: Ceres Clone ID no. 1657843
  misc_feature: Encodes the peptide sequence at SEQ ID NO. 56
attgtttccatttttcaagcctacatatacaacactactttcagttttttctgtctctgaatctcaaactcttcggaaagattaacattaatggctccaagggatatcaatagatccaacgttgttgttgttgccggagtatccaacccgacccataaagagatccgttaccgcggcgtgaggaagcggccgtggggccgctacgccgccgagatccgcgacccaggcaagaagacacgcgtgtggctaggaacgtttgacacggcggaggaggcggcgcgtgcgtatgacacggcggcgcgtgagttccgcggcacgaaggcgaagaccaatttccccacccacgcggcggcggcgcgtagtcccagccagagcagcacgctggactcctcgtctccgccgccgctggaccttactcttgccgccccactcaccgccgcgggcgcgttggttttcccggtggcgcgtcccgtggtgttcttcgacgcttttgcgcgtgccgaggtgcgcgcgtcgttcgatcttcccgtggcggggttcagcgactcggactcgtcctcggtcgtggactacgagcgggtcccacatcggaaagtgttggatcttgaccttaatgtccctcctccgcccgaggttgcctgaaccggcaaaagatccggttttaacgcggctcggtttttttctctctatctgagaatgatgattatcaagttatcattgtagttgacatggtgctagagtttatgtacatagattataattaaccaaacaaaaaaaaaaaagcaggcttatgttttttctctattctgcttttttattttctcaatggaagaagggatttcttacctcattattgccgttgatgttaacttttatatatataaaatagcatttatat

SEQ ID NO: 56 - protein, 183 aa, Glycine max
  misc_feature (25)..(76): Pfam Name: AP2 Pfam Description: AP2 domain
  misc_feature: Ceres Clone ID no. 1657843
  misc_feature: Bit score of 273.8 for HMM based on sequences of Figure 4
  misc_feature: Functional Homolog Of SEQ ID NO. 1
MAPRDINRSNVVVVAGVSNPTHKEIRYRGVRKRPWGRYAAEIRDPGKKTRVWLGTFDTAEEAARAYDTAAREFRGTKAKTNFPTHAAAARSPSQSSTLDSSSPPPLDLTLAAPLTAAGALVFPVARPVVFFDAFARAEVRASFDLPVAGFSDSDSSSVVDYERVPHRKVLDLDLNVPPPPEVA

SEQ ID NO: 57 - DNA, 633 bp, Populus balsamifera subsp. trichocarpa
  misc_feature: Ceres Annot ID no. 1455887
  misc_feature: Encodes the peptide sequence at SEQ ID NO. 58
atggcacccaagaagcttaatggtaatgacaatggttctttgaagaaagcaagtggtgatcatgacaagaaggaaatccattataggggagtgaggaagaggccatgggggaggtatgctgctgagataagggatcccgggaagaaaagccgggtttggttgggcacgtttgacacggcagtggaggctgcgagggcctatgataaggcggcgcgtgagtatcgtggtgctaaggcgaagaccaactttccaatagcggagaaggtggttgattatgacgatgagaagcagagctctagccagagcagcaccgttgagtcgtcaagctccccggtggtttctgcggtggcgcgtgatgtaactcgccaggttggtggggttgtggggatggggaggtttccctttgtgttccagcagcagccgccgcatgttaacgctgttggtcctgtctggtttcttgatagtactgttaagcctgagtttgtggctcagcgtttccctgtccggtatgacccggtgggtcttgagggcggggcccatagtgactcggattcatcatctgtgattgattttaagccaaggagttcaattcttcatcttgatcttaacctgcctccaccagctgatgcttga

SEQ ID NO: 58 - protein, 210 aa, Populus balsamifera subsp. trichocarpa
  misc_feature (26)..(77): Pfam Name: AP2 Pfam Description: AP2 domain
  misc_feature: Ceres Annot ID no. 1455887
  misc_feature: Bit score of 253.2 for HMM based on sequences of Figure 4
  misc_feature: Functional Homolog Of SEQ ID NO. 1
MAPKKLNGNDNGSLKKASGDHDKKEIHYRGVRKRPWGRYAAEIRDPGKKSRVWLGTFDTAVEAARAYDKAAREYRGAKAKTNFPIAEKVVDYDDEKQSSSQSSTVESSSSPVVSAVARDVTRQVGGVVGMGRFPFVFQQQPPHVNAVGPVWFLDSTVKPEFVAQRFPVRYDPVGLEGGAHSDSDSSSVIDFKPRSSILHLDLNLPPPADA

SEQ ID NO: 59 - protein, 223 aa, Solanum tuberosum
  misc_feature (28)..(79): Pfam Name: AP2 Pfam Description: AP2 domain
  misc_feature: Public GI ID no. 118490009
  misc_feature: Bit score of 281.5 for HMM based on sequences of Figure 4
  misc_feature: Functional Homolog Of SEQ ID NO. 1
MAPKEKIGAVTAAAVMAVGKLNGISKEVHYRGVRKRPWGRYAAEIRDPGKKSRVWLGTFDTAEEAAKAYDNAAREFRGAKAKTNFPQLLKEEDLKFPVKNEINRSPSQTSTVESSSPVMVDSSSPLDLRLCGSIGGFNHNTVRFPISGGGFTGAVPAVNHMYYLDALERAGVINLETNRKKTVDFLGGGDSDTSTVIDFMRVDVKPTIAGLNLDLNFPPPENM

SEQ ID NO: 60 - DNA, 908 bp, Brassica napus
  misc_feature: Ceres Clone ID no. 1381515
  misc_feature: Encodes the peptide sequence at SEQ ID NO. 61
accttcaattatcacaccgtcccctctctccctctccggttattacgttatggccaagatgggtttgaaacccgacccggttactcctaacccgacccacaataatgccaaggagattcgttacagaggcgtgaggaagcgtccttggggccgttacgccgccgagatccgagatccgggtaagaaaacccgcgtctggcttggcaccttcgataccgcagaggaggcggcgcgtgcttacgataaggcggcgcgtgatttccgtggcgctaaggcgaagacgaattttcttgagctgaatgagaaggtgctctccggtggaggcggtttcgcgcggagccctagccagagcagcacccttgactacgcttctcctccggcggtgactgatgggattgttccacctcaacttgagctaagtcttggcggcggcggtggcgcgtgttaccagatcccaatggcgcgtcctctctactttttggaccttatgggggtcggaaacggaggtcgtggtcagcttccggtgtcgccggtgatgcatgtctctacgaagatggcttgtggtgcccagagcgactctgattcttcatcggtcgttgatttcgaaagtgggatggagaagagatctcagccgttagatttagatctaaacttgcttcctccggtggaacaggcctgaggtgttgccggtttcgcgcatgcgttttttgctttgcagctgagagaataatttcacgtagtttttttctccatcactctaaaataattattatcggtttttagaaattatataaatcgagggagaaaaagtataattcttagatgacatgtatcgttatgtacataaccggagatctgaacttttgttgtgtgcttttttgcgacttggttttcaccatgttgtttct

SEQ ID NO: 61 - protein, 209 aa, Brassica napus
  misc_feature (23)..(74): Pfam Name: AP2 Pfam Description: AP2 domain
  misc_feature: Ceres Clone ID no. 1381515
  misc_feature: Bit score of 239.1 for HMM based on sequences of Figure 4
  misc_feature: Functional Homolog Of SEQ ID NO. 1
MAKMGLKPDPVTPNPTHNNAKEIRYRGVRKRPWGRYAAEIRDPGKKTRVWLGTFDTAEEAARAYDKAARDFRGAKAKTNFLELNEKVLSGGGGFARSPSQSSTLDYASPPAVTDGIVPPQLELSLGGGGGACYQIPMARPLYFLDLMGVGNGGRGQLPVSPVMHVSTKMACGAQSDSDSSSVVDFESGMEKRSQPLDLDLNLLPPVEQA

SEQ ID NO: 62 - DNA, 845 bp, Arabidopsis thaliana
  misc_feature: Ceres Clone ID no. 22775
  misc_feature: Encodes the peptide sequence at SEQ ID NO. 63
ttcaattatctatcacaccaccactctctctctaatctatctatccgagaatggccaagatgggcttgaaacccgacccggctactactaaccagacccacaataatgccaaggagattcgttacagaggcgttaggaagcgtccttggggccgttatgccgccgagatccgagatccgggcaagaaaacccgcgtctggcttggcactttcgatacggctgaagaggcggcgcgtgcttacgatacggcggcgcgtgattttcgtggtgctaaggctaagaccaatttcccaacttttctcgagctgagtgaccagaaggtccctaccggtttcgcgcgtagccctagccagagcagcacgctcgactgtgcttctcctccgacgttagttgtgccttcagcgacggctgggaatgttcccccgcagctcgagcttagtctcggcggaggaggcggcggctcgtgttatcagatcccgatgtcgcgtcctgtctactttttggacctgatggggatcggtaacgtaggtcgtggtcagcctcctcctgtgacatcggcgtttagatcgccggtggtgcatgttgcgacgaagatggcttgtggtgcccaaagcgactctgattcgtcatcggtcgttgatttcgaaggtgggatggagaagagatctcagctgttagatctagatcttaatttgcctcctccatcggaacaggcctgagcttttaacggtgtcgtttcaattcgaagcgcatgcgtttcttcttctttttgagctgtgaaaattcgttttctcatagtttttcctctctctctctctcagtctaaatttattaccagtttttag

SEQ ID NO: 63 - protein, 222 aa, Arabidopsis thaliana
  misc_feature (23)..(74): Pfam Name: AP2 Pfam Description: AP2 domain
  misc_feature: Ceres Clone ID no. 22775
  misc_feature: Bit score of 275.2 for HMM based on sequences of Figure 4
  misc_feature: Functional Homolog Of SEQ ID NO. 1
MAKMGLKPDPATTNQTHNNAKEIRYRGVRKRPWGRYAAEIRDPGKKTRVWLGTFDTAEEAARAYDTAARDFRGAKAKTNFPTFLELSDQKVPTGFARSPSQSSTLDCASPPTLVVPSATAGNVPPQLELSLGGGGGGSCYQIPMSRPVYFLDLMGIGNVGRGQPPPVTSAFRSPVVHVATKMACGAQSDSDSSSVVDFEGGMEKRSQLLDLDLNLPPPSEQA

SEQ ID NO: 64 - protein, 211 aa, Capsicum annuum
  misc_feature (23)..(74): Pfam Name: AP2 Pfam Description: AP2 domain
  misc_feature: Public GI ID no. 60459377
  misc_feature: Bit score of 375.5 for HMM based on sequences of Figure 4
  misc_feature: Functional Homolog Of SEQ ID NO. 1
MALKSKVSSNGSENAKVNGVKEVHYRGVRKRPWGRYAAEIRDPGKKSRVWLGTFDTAEEAAKAYDAAARDFRGPKAKTNFPSPFPLETLNQSPSNSSTLESSSGETGVHAPMEVDLTRRLGAVAPVFHQQPTVAVLPNGQPVLLFDSLWRPGVVVDKAQLSYQVAPMAIEFTGAAGGVSSVSDSSSVVEENQYVGKKGLDLDLNLAPPMEI

SEQ ID NO: 65 - DNA, 648 bp, Populus balsamifera subsp. trichocarpa
  misc_feature: Ceres Annot ID no. 1488231
  misc_feature: Encodes the peptide sequence at SEQ ID NO. 66
atggcacccaagaagcttaatgccagcaacagtggctgtttcaagaaagcaagtggggatcatgacaagaaagagatacattacaggggagtgaggaagaggccgtgggggaggtatgctgctgagataagggatcccgggaagaaaagccgggtttggctgggtacttttgatacggcggaggaggctgctaaagcctatgataaagcggcgcgtgagtatcggggtgctaaggcgaagaccaactttcctttttccggggaggtggttaattatgacgatgacaagcagagttctagccatagcagcaccgtggagtcgtcgagctctccggttgtttctgctgcggtgacccgccaggttggtggtggtggagtgggcggggttgtggggatgggagggtttccttttgtgtaccagcagcagcagcagcagcagaatgttaacgttgttgctcctgtctggttttttgatagtgtgaggcctgagtttgtgactcagcgattccctgtccggtttgaccaggtgggtcttgagagtgctggtggggcccagagtgactcggattcatcatctatggttgattgtcagccacggagatcagttcttgatcttgatcttaacctgcctccaccgctggatgcttga

SEQ ID NO: 66 - protein, 215 aa, Populus balsamifera subsp. trichocarpa
  misc_feature (26)..(77): Pfam Name: AP2 Pfam Description: AP2 domain
  misc_feature: Ceres Annot ID no. 1488231
  misc_feature: Bit score of 250.5 for HMM based on sequences of Figure 4
  misc_feature: Functional Homolog Of SEQ ID NO. 1
MAPKKLNASNSGCFKKASGDHDKKEIHYRGVRKRPWGRYAAEIRDPGKKSRVWLGTFDTAEEAAKAYDKAAREYRGAKAKTNFPFSGEVVNYDDDKQSSSHSSTVESSSSPVVSAAVTRQVGGGGVGGVVGMGGFPFVYQQQQQQQNVNVVAPVWFFDSVRPEFVTQRFPVRFDQVGLESAGGAQSDSDSSSMVDCQPRRSVLDLDLNLPPPLDA

SEQ ID NO: 67 - DNA, 1024 bp, Gossypium hirsutum
  misc_feature: Ceres Clone ID no. 1884969
  misc_feature: Encodes the peptide sequence at SEQ ID NO. 68
aaaccaaaatatttacaaccctgagagagaaaaaaagggaaagaaaagtttttatggctccccaagacaaaaatgcgagcaaaatcttgaagaaagctaacgttactggaagtacgagcagccaagaggtgcatttcaggggagtaaggaagaggccatggggtaggtacgctgccgaaatcagagatcccggaaagaaaagccgtgtttggcttggtactttcgatacggctgaggaagctgccagagcctacgacgcggcggcgcgtgagtttcgtggacctaaggctaagaccaacttccctttaccggatgaaaccaactgttacaagggccagaaccagcagagccctagccaaagcagcacggtagaggaatctggaagcccaacggtggagcgtggagtcaacactgtgaccggggcagtagggagattccctttcgcgtgccaccagcagctggctctgggtggtggagtcgctaatggtgggattagcggggtgacccagtcgcggccggttctatttatcgaagcgttgggaggagctggcgttgttggtcaggtttatccggttcggttcgatccggtgggagtgcagttgggtatgggatttgcaagtgttgtccgaagtgaaccggactcttcatcggccattcattgcaaggcaaggagacctggccttgtcctcgatcttaaccttcctcctccagtcgatgcttgatgttttgcattttttttttctttttttcttttttttttacgggaaacgccctttcatcatcttaatttaagacatctgagaggtaggaagctatgataaacaagaggtgatagtaatccgtattttgtatcattttagacatgattttatccttaaatcctatgtaaatagttttacgatagtaatccgtgtttgcaaactgagaggaaaactatgatccattatcttagatgattttgtttataacctctcgttcaaaattaaccattcttttttactttcaatgagaatctttcttattt

SEQ ID NO: 68 - protein, 222 aa, Gossypium hirsutum
  misc_feature (26)..(77): Pfam Name: AP2 Pfam Description: AP2 domain
  misc_feature: Ceres Clone ID no. 1884969
  misc_feature: Bit score of 260.6 for HMM based on sequences of Figure 4
  misc_feature: Functional Homolog Of SEQ ID NO. 1
MAPQDKNASKILKKANVTGSTSSQEVHFRGVRKRPWGRYAAEIRDPGKKSRVWLGTFDTAEEAARAYDAAAREFRGPKAKTNFPLPDETNCYKGQNQQSPSQSSTVEESGSPTVERGVNTVTGAVGRFPFACHQQLALGGGVANGGISGVTQSRPVLFIEALGGAGVVGQVYPVRFDPVGVQLGMGFASVVRSEPDSSSAIHCKARRPGLVLDLNLPPPVDA

SEQ ID NO: 69 - DNA, 961 bp, Panicum virgatum
  misc_feature: Ceres Clone ID no. 1802100
  misc_feature: Encodes the peptide sequence at SEQ ID NO. 70
aatccatcctctcctcgcgagctccaacagcaatcaagctagagagaagcttaggctgcaagaagaagccagcaagaggcgaggacgcgagcagggcaagcgagatcactcggaccaagcgatccatggcgccgaggaggtcgacttcgccggccgggagcggcagcagcggcggcggcggcggcgcggagcagccgaggctgcgcggcgtgcggaagcggccgtggggccggtacgcggcggagatccgcgaccccgtgcggaaggcgcgcgtgtggctggggaccttcgacacgcccgaggaggcggcgcgcgcctacgacgccgccgcgcgcaggctccgcgggccgcgcgcagccaccaactaccccgcccacgcccaggacccgaaggcggcggccgcggcgattccggcgtcgagcgctagcgcgagcgggagcggggtgctgtcgtcggaggacgcgtcgtcgtcgtcctcctgccgggactcgccgctggcgcccccgtcgctggacctgagcctggcgctcccggccgtggcggccgcgccgccgccgtattcgtaccagcagctgttcctggacccggcggcgatggtggccgcggcgccggcgctgctgcagttcctgccgcccaagagtgaggaagaacagagctgctcagggtcgagctcctcctcgtcggtggtggtcgacgcggcgccggcggtgggcctggggctggacctgaacctggcgctcgcggccgggatggtgatgtagagacaagaccaatgatttggttaattagtggctcctagctcaccgatccagatgttcacccggtgtaaatagtcggcccgcagggatttatttgtgcatctgcgcagccagttctctttgcttcctttttgtacccacagatttcgcgtcccgcaaagatgcgcgccaacgcaagaaggaagaaactttgccccagccac

SEQ ID NO: 70 - protein, 211 aa, Panicum virgatum
  misc_feature (24)..(75): Pfam Name: AP2 Pfam Description: AP2 domain
  misc_feature: Ceres Clone ID no. 1802100
  misc_feature: Bit score of 122.3 for HMM based on sequences of Figure 4
  misc_feature: Functional Homolog Of SEQ ID NO. 1
MAPRRSTSPAGSGSSGGGGGAEQPRLRGVRKRPWGRYAAEIRDPVRKARVWLGTFDTPEEAARAYDAAARRLRGPRAATNYPAHAQDPKAAAAAIPASSASASGSGVLSSEDASSSSSCRDSPLAPPSLDLSLALPAVAAAPPPYSYQQLFLDPAAMVAAAPALLQFLPPKSEEEQSCSGSSSSSSVVVDAAPAVGLGLDLNLALAAGMVM

SEQ ID NO: 71 - protein, 222 aa, Gossypium barbadense
  misc_feature (26)..(77): Pfam Name: AP2 Pfam Description: AP2 domain
  misc_feature: Public GI ID no. 156145802
  misc_feature: Bit score of 261.7 for HMM based on sequences of Figure 4
  misc_feature: Functional Homolog Of SEQ ID NO. 1
MAPQDKNASKTLKKANGTGSTSSQEVHFRGVRKRPWGRYAAEIRDPGKKSRVWLGTFDTAEEAAKAYDAAAREFRGPKAKTNFPLPDETNCYKGQNQQSPSQSSTVEESGSPTVERGVNTLSGAVGRFPFACHQQLALGGGVANGGISGVTRSRPVLFFEALGGAGVVGQVYPVRFDPVGVQLGMGFASVVRSEPDSSSAIHCKARRPGLALDLNLPPPVDA

SEQ ID NO: 72 - protein, 222 aa, Solanum lycopersicum
  misc_feature (25)..(76): Pfam Name: AP2 Pfam Description: AP2 domain
  misc_feature: Public GI ID no. 28274832
  misc_feature: Bit score of 272.3 for HMM based on sequences of Figure 4
  misc_feature: Functional Homolog Of SEQ ID NO. 1
MAPKEKIGAVTAMAMVNLNGISKEVHYRGVRKRPWGRYAAEIRDPGKKSRVWLGTFDTAEEAARAYDNAAREFRGAKAKTNFPKLEMEKEEDLKFAVKNEINRSPGQTSTVESSSPVMVDSSSPLDLSLCGSIGGFNHHTVKFPSSGGGFTGSVQAVNRMYYIEALARAGVIKLEQIGRKRLDYLGGGDSDSSTVIDFMRVDVKSTTAGLNLDLNFPPPENM

SEQ ID NO: 73 - DNA, 1126 bp, Triticum aestivum
  misc_feature: Ceres Clone ID no. 568399
  misc_feature: Encodes the peptide sequence at SEQ ID NO. 74
ccccccagctccaaccagccagaccatccaaccaacgccgcaccgcaacaacaaccgccgcgcacgcgccgagcacggtcgaacacttgccatggctcccaagaacgcgctccccgtcgccgtcgccgccgccgcggacgccggcatggagcccaggttccgcggcgtgcgcaagcggccgtggggcaggtacgcggcggagatccgcgacccggccaggaaggcccgcgtctggctcggcaccttcgacaccgccgaggccgcggcccgcgcctacgacgccgccgcgctccactaccgcgggcccaaggccaagaccaacttccccgtcggcaccgtcgccgccttcgcccacgtcccgctcccgccgcccaaggcgctggccgtcagccccagcagcagcaccgtcgagtcttcgtcccgggacacgccggccgcggcgcccgccgctcctgctgctgctgcccccgcgcccccgccggcgctcgacctgagcctggcgatgccggccatggtggcggcgcagccgttcctgttcctggaccccagggtcgcggtgaccgtggccgtggccgcgccggcgccggccccctgccggtcagcggcgatcagcggcatgaacaaggtggcgtcccgcgaggaagagcagagcgacaccgggtcgtcgtcatccgtggtggacgcctcgccggccgtgggcgtggggttcgacctgaacctgccgccgccggtggagatggcgtaggagatggaccgatctcggtcgcccgatgacgacgcggcccggaagtaaagcaaagcgctctcgtggtagaatttaaagtttagaagaatggcgtgtacttactagtaagaggttaatcggccgtttaattgccaggatcgatccatcgatgggtaagggtaagtaggtgtacatagatcgcgtgcgtgcgttttttgcatggggaggcaggtaggatgaaacacatccatctatctgctcccaatgttacttacaatttccttaaaagcaagggaaaaaaagacaaaaaggaagaagccagtagtagagcattttgttcttcagtgtacaatatttgatctctgtctctcggattaatgtgaaatttatgatttccattcc

SEQ ID NO: 74 - protein, 217 aa, Triticum aestivum
  misc_feature (21)..(72): Pfam Name: AP2 Pfam Description: AP2 domain
  misc_feature: Ceres Clone ID no. 568399
  misc_feature: Bit score of 188.5 for HMM based on sequences of Figure 4
  misc_feature: Functional Homolog Of SEQ ID NO. 1
MAPKNALPVAVAAAADAGMEPRFRGVRKRPWGRYAAEIRDPARKARVWLGTFDTAEAAARAYDAAALHYRGPKAKTNFPVGTVAAFAHVPLPPPKALAVSPSSSTVESSSRDTPAAAPAAPAAAAPAPPPALDLSLAMPAMVAAQPFLFLDPRVAVTVAVAAPAPAPCRSAAISGMNKVASREEEQSDTGSSSSVVDASPAVGVGFDLNLPPPVEMA

SEQ ID NO: 75 - protein, 222 aa, Oryza sativa subsp. japonica
  misc_feature (24)..(75): Pfam Name: AP2 Pfam Description: AP2 domain
  misc_feature: Public GI ID no. 115460458
  misc_feature: Bit score of 183.4 for HMM based on sequences of Figure 4
  misc_feature: Functional Homolog Of SEQ ID NO. 1
MAPRNAAEAVAVAVAEGGGAGMEPRFRGVRKRPWGRYAAEIRDPARKARVWLGTFDTAEAAARAYDSAALHFRGPKAKTNFPVAFAHAHHHAPPPPLPKAAALAVVSPTSSTVESSSRDTPAAAPVAAAAKAQVPASPSLDLSLGMSAMVAAQPFLFLDPRVAVTVAVAAPVPRRPAVVSVKKEVARLDEQSDTGSSSSVVDASPAVGVGLDLNLPPPIEEA

SEQ ID NO: 76 - DNA, 561 bp, Arabidopsis thaliana
  misc_feature: Ceres Clone ID no. 4831
  misc_feature: Encodes the peptide sequence at SEQ ID NO. 77
gctctagtttcccccaacaatcgccatggcagcttcgtctctcaatctcctcctcattctctctcttctcactttcatttctctccagagatctgaatctctttccgataatccatctctcactcttctacccgacggattcgactggccgatctctcactccgatgaattcgatatcatcgacggtgaagaaagcttcgaagttacggaggaagacgacggcgtaacagatcgacggtcattgtactggcggaggacgaagtattacatatcgtacggtgcattgtcggcgaatagagtgccatgtcctcccagatctggaagatcgtactacactcataactgcttcagagctagaggtcccgttcatccgtatagcctaggctgctcgtcgatcactcccggagatagatgaagaaagcttaaaactccatgggcattttcgtaattttgccaaccatggtttattattatgatgtttgtatttgtaatgttcgatgtttgtttgtaaaccgtgattagttacgttcgttaaacggtaaacccgatgattataatttc

SEQ ID NO: 77 - protein, 129 aa, Arabidopsis thaliana
  misc_feature (57)..(129): Pfam Name: RALF Pfam Description: Rapid ALkalinization Factor (RALF)
  misc_feature: Ceres Clone ID no. 4831
  misc_feature: Bit score of 330.2 for HMM based on sequences of Figure 9
MAASSLNLLLILSLLTFISLQRSESLSDNPSLTLLPDGFDWPISHSDEFDIIDGEESFEVTEEDDGVTDRRSLYWRRTKYYISYGALSANRVPCPPRSGRSYYTHNCFRARGPVHPYSLGCSSITPGDR

SEQ ID NO: 78 - DNA, 666 bp, Brassica napus
  misc_feature: Ceres Clone ID no. 1387948
  misc_feature: Encodes the peptide sequence at SEQ ID NO. 79
gcatgtgagttgctaattactactctcttcttctattattaactttcttcctcttcttcttcttcgcttccctctccagcatcgccatggcagctgctccgcctcttactctcctcatcgctctctctcttctcttcatttcactccagagatctgaatctctccccgagaatccatccatgattcttctaggcgacggattcgactggccgatctctcacggcgacgcattagacatcgacggaggagaaagctttgaagatgcggaggaggaagatgtcgcggatcgacggtcattgtactggaagaggaggagatactacatctcttacggcgcattgtcggcgaacagagtcccgtgtcctcccagatctggaagatcgtactacactcacaactgcttcagagctagaggtcaggtgcatccctacagtcgaggctgctcctccatcactcggtgccggagatagaagaaaccacgggggcattctcgtaattttccaatcacggactctgtttgtagttctcgttcgatttcgatgtgttgtgtagtaaaccgtgattagttacgtttgtttaaattaattaagcccgcggtattattattattcgagtgatatctatatgtattcaactttgtggtaattgttatttattttgtcggtg

SEQ ID NO: 79 - protein, 127 aa, Brassica napus
  misc_feature (55)..(127): Pfam Name: RALF Pfam Description: Rapid ALkalinization Factor (RALF)
  misc_feature: Ceres Clone ID no. 1387948
  misc_feature: Bit score of 307.4 for HMM based on sequences of Figure 9
  misc_feature: Functional Homolog Of SEQ ID NO. 77
MAAAPPLTLLIALSLLFISLQRSESLPENPSMILLGDGFDWPISHGDALDIDGGESFEDAEEEDVADRRSLYWKRRRYYISYGALSANRVPCPPRSGRSYYTHNCFRARGQVHPYSRGCSSITRCRR

SEQ ID NO: 80 - DNA, 898 bp, Gossypium hirsutum
  misc_feature: Ceres Clone ID no. 1937714
  misc_feature: Encodes the peptide sequence at SEQ ID NO. 81
ccttcacctctgcaacttgttagctgtttaccaacaatggcttcttcttcggttctcagcaagcttcttttgccccttttcctcactcacattgccgtctcgatctcgaaaaccgaagctcaagttgaagacacaaggttgaagctggtgagagatgctttcgaatggccactttcaatgtcgtttcagggtgacttacacgacaatgaagaaggcgatgaggaggtagatgatgaagttgaaaatgggtatagtggtagatctttgttgtggtggaagagaatgaggtattacatttcgtatggggcgctttcggctaacagaatcccatgtccaccaaggtcaggcaggtcttattatactcacaactgtttcaaggctcatggccctgttcatccttataccaggggatgttccaggatcactcgctgcaggagatgaggttttaaatttagccctttttagaatctgggtttgtattagttaatcattattttgcgaaatgtggaagatttgagtgttttgggatttggggcttctttttgcccttcgtttagtatttgaagagcatcatgtgtcataaggttaaactactttatgattatggtagtttttattatatgtatagttttggtctggaagggcgggggtgttcattggcagtcgctattttatatcatatatgtgatctcatcaacttacctgtaaatgcttgaagacctgaatcctgctgttgcgtgctgcaacaaacgccgcagcttgaaaaggtgaactagtcaccaaaattttccgccttaattttaaataattattaaataattcgataatttttattatttaaaatcgttgttatatatttttctttgtcaccatttgtattaatcaaaagtttttaccc

SEQ ID NO: 81 - protein, 134 aa, Gossypium hirsutum
  misc_feature (58)..(134): Pfam Name: RALF Pfam Description: Rapid ALkalinization Factor (RALF)
  misc_feature: Ceres Clone ID no. 1937714
  misc_feature: Bit score of 363.8 for HMM based on sequences of Figure 9
  misc_feature: Functional Homolog Of SEQ ID NO. 77
MASSSVLSKLLLPLFLTHIAVSISKTEAQVEDTRLKLVRDAFEWPLSMSFQGDLHDNEEGDEEVDDEVENGYSGRSLLWWKRMRYYISYGALSANRIPCPPRSGRSYYTHNCFKAHGPVHPYTRGCSRITRCRR

SEQ ID NO: 82 - protein, 125 aa, Vitis vinifera
  misc_feature (53)..(125): Pfam Name: RALF Pfam Description: Rapid ALkalinization Factor (RALF)
  misc_feature: Public GI ID no. 157345132
  misc_feature: Bit score of 344.6 for HMM based on sequences of Figure 9
  misc_feature: Functional Homolog Of SEQ ID NO. 77
MACSSLPKLLVLCAFFVYISNVVVVAQVDESSLKLITDSLEWPSTMSLYNEFGDEDGEDPDGVIDRRSMFWHRMRYYISYGALSANRIPCPPRSGRSYYTHNCFQARGPVRPYTRGCSTITRCRR

SEQ ID NO: 83 - DNA, 696 bp, Glycine max
  misc_feature: Ceres Clone ID no. 464828
  misc_feature: Encodes the peptide sequence at SEQ ID NO. 84
gatggcttctcttctcaccctcgctctgttactcttctgcattgcctttacctcccacgttgccgtgcaggcgcacatggaggacacggccttcaacctcatgtcggacgccttggagtggcccaccacaatgtcgctctacgacgaagacgacgcccaagaggatgtcgagaacgcttacagtcggagatcgttgttctggcggcggatgaagtactacatctcctacggtgctctttctgctaaccgaattccttgcccgcctcgttctggtagatcttactacacccacaactgctacagggcacgaggccccgttcacccttactccagaggatgctctgccatcacgcgctgccggagatgagtttgatgtgagttccgatctgatcacacgcttcagatcggagatggaaataaaaaaaccgagtaccgtttatggtggttttgttttgttttgttttattggtgtactagatttatattgtggatttaaggcgtcgttagttgtgctaagcaagtcaagtcaagtgaaagtgtcgtgtttgagttaacggtttttggggattcttcacttgcatcgactcgttgcgctgcgcaaatgaatctgcttgctttttgtgttacttcgtcatttattcgtttgtataaacccaacggtttctttttcttggtgttcagagcactttcagtttc

SEQ ID NO: 84 - protein, 121 aa, Glycine max
  misc_feature (49)..(121): Pfam Name: RALF Pfam Description: Rapid ALkalinization Factor (RALF)
  misc_feature: Ceres Clone ID no. 464828
  misc_feature: Bit score of 319.9 for HMM based on sequences of Figure 9
  misc_feature: Functional Homolog Of SEQ ID NO. 77
MASLLTLALLLFCIAFTSHVAVQAHMEDTAFNLMSDALEWPTTMSLYDEDDAQEDVENAYSRRSLFWRRMKYYISYGALSANRIPCPPRSGRSYYTHNCYRARGPVHPYSRGCSAITRCRR

SEQ ID NO: 85 - DNA, 405 bp, Populus balsamifera subsp. trichocarpa
  misc_feature: Ceres Annot ID no. 1451368
  misc_feature: Encodes the peptide sequence at SEQ ID NO. 86
atggcagcttctacattgcaataccatttcgccttcttcatcttctttctcgtaattgcttctttcagtccaagaatccaagctcaagttgatgaaacaagcttgaaggcaatgagagatgcactagaatggccaatgtccatgtattatgatgaaagcagcggtctcaatgatgggttagtgggttttgacgatggagttgttgacgatgaagaaagtagtcgtagatctttgttttggaggagaacgcattattatatctcgtatggagctttgtctgctaatagaattccttgtccagcgaggtccgggcgatcctactacagccacaattgcttcgcgtctagagctccagtgaatccctattccagagggtgttctaggatcgctcgttgcaggagatga

SEQ ID NO: 86 - protein, 134 aa, Populus balsamifera subsp. trichocarpa
  misc_feature (62)..(134): Pfam Name: RALF Pfam Description: Rapid ALkalinization Factor (RALF)
  misc_feature: Ceres Annot ID no. 1451368
  misc_feature: Bit score of 340.5 for HMM based on sequences of Figure 9
  misc_feature: Functional Homolog Of SEQ ID NO. 77
MAASTLQYHFAFFIFFLVIASFSPRIQAQVDETSLKAMRDALEWPMSMYYDESSGLNDGLVGFDDGVVDDEESSRRSLFWRRTHYYISYGALSANRIPCPARSGRSYYSHNCFASRAPVNPYSRGCSRIARCRR

SEQ ID NO: 87 - protein, 123 aa, Solanum chacoense
  misc_feature (52)..(123): Pfam Name: RALF Pfam Description: Rapid ALkalinization Factor (RALF)
  misc_feature: Public GI ID no. 37695575
  misc_feature: Bit score of 304.5 for HMM based on sequences of Figure 9
  misc_feature: Functional Homolog Of SEQ ID NO. 77
MESPILFFLIIFLFTITNNAIVIEAQVDKFGLEQLVSEDFELPMAMSSLYEETEDDEMQLDGNGRSLLWHKFKYYISYGALSANRIPCPPRSGRSYYTHHCYHATGPAHPYTRGCSAITRCRR

SEQ ID NO: 88 - protein, 100 aa, Picea sitchensis
  misc_feature (31)..(97): Pfam Name: RALF Pfam Description: Rapid ALkalinization Factor (RALF)
  misc_feature: Public GI ID no. 116790033
  misc_feature: Bit score of 213.1 for HMM based on sequences of Figure 9
  misc_feature: Functional Homolog Of SEQ ID NO. 77
MDGLITRSNPPPQPKCAMMEAWGECGANVDEENENEVGHGRLLRRIRYYISYGALAANRIPCPPRSGRSYYTRNCYRATEPVRPYHRSCTAITRCLRDTS

SEQ ID NO: 89 - DNA, 716 bp, Arabidopsis thaliana
  misc_feature: Ceres Clone ID no. 1346042
  misc_feature: Encodes the peptide sequence at SEQ ID NO. 90
aattagaacccccaaaatctcttcacaactgtaaaaccccaatcacctctttacatgtgacttccttattactctcttcttcttattttcctcctcttcttcttcgctctagtttcccccaacaatcgccatggcagcttcgtctctcaatctcctcctcattctctctcttctcactttcatttctctccagagatctgaatctctttccgataatccatctctcactcttctacccgacggattcgactggccgatctctcactccgatgaattcgatatcatcgacggtgaagaaagcttcgaagttacggaggaagacgacggcgtaacagatcgacggtcattgtactggcggaggacgaagtattacatatcgtacggtgcattgtcggcgaatagagtgccatgtcctcccagatctggaagatcgtactacactcataactgcttcagagctagaggtcccgttcatccgtatagccgaggctgctcgtcgatcactcgatgccggagatagatgaagaaagcttaaaactccatgggcattttcgtaattttgccaaccatggtttattattatgatgtttgtatttgtaatgttcgatgtttgtttgtaaaccgtgattagttacgttcgttaaacggtaaacccgatgattataatttcgagttctgctatagaaatggttaagtactaaagagtcgtgaggggt

SEQ ID NO: 90 - protein, 129 aa, Arabidopsis thaliana
  misc_feature (57)..(129): Pfam Name: RALF Pfam Description: Rapid ALkalinization Factor (RALF)
  misc_feature: Ceres Clone ID no. 1346042
  misc_feature: Bit score of 340.8 for HMM based on sequences of Figure 9
  misc_feature: Functional Homolog Of SEQ ID NO. 77
MAASSLNLLLILSLLTFISLQRSESLSDNPSLTLLPDGFDWPISHSDEFDIIDGEESFEVTEEDDGVTDRRSLYWRRTKYYISYGALSANRVPCPPRSGRSYYTHNCFRARGPVHPYSRGCSSITRCRR

SEQ ID NO: 91 - DNA, 491 bp, Brassica napus
  misc_feature: Ceres Clone ID no. 1118610
  misc_feature: Encodes the peptide sequence at SEQ ID NO. 92
aacttyctcttcttcttcttcgttttcgcctccaccatcaccatggcagcagctccgtctcttactctattcatcactctctcccttctcttcatttcactccagagatctgaatctctcccccagaatccatccatgattcttctaggcgacggattcgactggccgatctctcacggcgacgcattcgacatcgacggaggagaaagctttgaagatgtcgcggatcgacggtcattgtactggaagaggaggagatactacatctcttacggtgcattgtcggcgaacagagtaccgtgtcctcccagatctggaagatcgtactacactcacaactgcttcagagctagaggtccggtgcatccttacagccgaggctgctcctccatcactcggtgccggagatagaagaaaccaagggcattctcgtaattttccaatcacggactctgtttgtagttctcgttcgatttcgatgtattgtgtag

SEQ ID NO: 92 - protein, 122 aa, Brassica napus
  misc_feature (50)..(122): Pfam Name: RALF Pfam Description: Rapid ALkalinization Factor (RALF)
  misc_feature: Ceres Clone ID no. 1118610
  misc_feature: Bit score of 282.1 for HMM based on sequences of Figure 9
  misc_feature: Functional Homolog Of SEQ ID NO. 77
MAAAPSLTLFITLSLLFISLQRSESLPQNPSMILLGDGFDWPISHGDAFDIDGGESFEDVADRRSLYWKRRRYYISYGALSANRVPCPPRSGRSYYTHNCFRARGPVHPYSRGCSSITRCRR

SEQ ID NO: 93 - DNA, 496 bp, Brassica napus
  misc_feature: Ceres Clone ID no. 982000
  misc_feature: Encodes the peptide sequence at SEQ ID NO. 94
ataaatggcgcattagttaaaacctcaagtcacctcttggcatgtgacttactagttcctctactctcttccattattattttccttcttctttgctttcgtctcaagcatatcaccatggcagcagctccgtctcttaacctcctcctcatcattctctctcttctcctcgtttcactcccaagatccgaatctctccccgagaatccatccctgattcttctaggcgagggattcgactggccgatctctgatggcggcattggcggaggagaaagcttcgaagacgcggaggaggaagaggacaacgtcggtgttgtagatcgacggtcattgtactggcacaggaagagatattacatatcgtacggtgcattgtcggcgaacagagtcccgtgtcctcccagatctggaagatcgtactacactcacaactgcttcagagctagaggtcccgtgcatccctacagtcgaggctgctcgtccatcactcgat

SEQ ID NO: 94 - protein, 126 aa, Brassica napus
  misc_feature (57)..(126): Pfam Name: RALF Pfam Description: Rapid ALkalinization Factor (RALF)
  misc_feature: Ceres Clone ID no. 982000
  misc_feature: Bit score of 255.0 for HMM based on sequences of Figure 9
  misc_feature: Functional Homolog Of SEQ ID NO. 77
MAAAPSLNLLLIILSLLLVSLPRSESLPENPSLILLGEGFDWPISDGGIGGGESFEDAEEEEDNVGVVDRRSLYWHRKRYYISYGALSANRVPCPPRSGRSYYTHNCFRARGPVHPYSRGCSSITR

SEQ ID NO: 95 - DNA, 567 bp, Brassica napus
  misc_feature: Ceres Clone ID no. 959670
  misc_feature: Encodes the peptide sequence at SEQ ID NO. 96
attgtctcacacactcgaaaactctcacacgaaggtcgaaaggtccataaatggcgcattagttaaaacctcaaaccacctcttcgcatgtgacttgctagttgctctactctcttccattattattttccttcttctttgcttgagtctcaagcatatcgccatggcagcagctccgtctcttaacctcctcatcatcacactatttcttctcatcatttcactcccaagatctgaatctctccccgagaatccatccctgcttgttctaggcgacggattcgactggccgatctctgatggcggcattggcggaggagaaagcttcgaagacgcggaggaggaagaggacaacgtcggtgtcggagatcgacggtcattgtactggcacaggaagagatactacatatcgtacggtgcattgtcggcgaacagagtcccgtgtcctcccagatctggaagatcgtactacactcacaactgcytcagagctagaggtccggtgcatccctacactcgaggctgstcgtccatcactcgatgccggagataactaggagaaaagac

SEQ ID NO: 96 - protein, 129 aa, Brassica napus
  misc_feature (57)..(129): Pfam Name: RALF Pfam Description: Rapid ALkalinization Factor (RALF)
  misc_feature: Ceres Clone ID no. 959670
  misc_feature: Bit score of 267.2 for HMM based on sequences of Figure 9
  misc_feature: Functional Homolog Of SEQ ID NO. 77
  misc_feature (108)..(108): Xaa is any aa, unknown, or other
  misc_feature (121)..(121): Xaa is any aa, unknown, or other
MAAAPSLNLLIITLFLLIISLPRSESLPENPSLLVLGDGFDWPISDGGIGGGESFEDAEEEEDNVGVGDRRSLYWHRKRYYISYGALSANRVPCPPRSGRSYYTHNCXRARGPVHPYTRGXSSITRCRR

SEQ ID NO: 97 - DNA, 422 bp, Brassica napus
  misc_feature: Ceres Clone ID no. 952522
  misc_feature: Encodes the peptide sequence at SEQ ID NO. 98
gtgtgtgtgtgtgtgacctgctgctctcttcttactcgctttcttctccagcattgccatggaagctccgtctcttactcttaacctcctcctccttatcattgtctctcttctcttcatttcactcccgagatctgaacctctcccggaaaacccatccttggttcttcttggcgacggattcgaatggccgacctctcacgtcgacgcattcgacatagaaagctttgacgatgcgggggaggaggaagacgacgacgtcggtgtatcagatcgacggtcgttgtactggaaaaggaggagatactacatctcctacggtgcattgtcggcgaacagagtcccctgtcctccgagatctggaaggtcttactacactcacaactgctttagagctagaggtccagttcatacctacactc

SEQ ID NO: 98 - protein, 121 aa, Brassica napus
  misc_feature (60)..(121): Pfam Name: RALF Pfam Description: Rapid ALkalinization Factor (RALF)
  misc_feature: Ceres Clone ID no. 952522
  misc_feature: Bit score of 213.6 for HMM based on sequences of Figure 9
  misc_feature: Functional Homolog Of SEQ ID NO. 77
MEAPSLTLNLLLLIIVSLLFISLPRSEPLPENPSLVLLGDGFEWPTSHVDAFDIESFDDAGEEEDDDVGVSDRRSLYWKRRRYYISYGALSANRVPCPPRSGRSYYTHNCFRARGPVHTYT

SEQ ID NO: 99 - DNA, 888 bp, Gossypium hirsutum
  misc_feature: Ceres Clone ID no. 1914539
  misc_feature: Encodes the peptide sequence at SEQ ID NO. 100
acaaacatcacaaaatcaacggcaaaagccaatctaaaaccatggaatgctaccacacagaacacgatcaattccatttgattggctcaagaaccgaagcacgcggtaatggagggcatcgattgaaagcacagctgtaaatcaatcatctctgtgctgattgtgaccccatctgtccccttaaaccgaaccccaaaacgaaaaccacttcaattattctcttcttcatccaaaactctccttgcaagcaacttgttactgacaatggcttcttcttcacttctcagcaagctccttttgctccttttcatctcttacattgtgttgtggggatcgaaagtggatgcccaagttgaagagacaagcttgaagctgatgagagatgctttggaatggccgctttctgtgtcactttacagtgacttaaacgacaatgaaggtgaagaagaggtagatggtgaagaggaaactgggcatagtcgtagatccttgttttggacgagaatgaggtattacatttcgtactcggcgctttctgctaatagaatcccatgtcccccaagatcaggaaggtcttattataccaacaactgtttcaaggcacatggatcagtccacccttactctagaggatgctccaggattacccgctgcaggagatgagtttttcttttttctttttctttttagtggatgctttgggtttgtaatattttaatgtgtattttgtgagaactatggaggaattgagtgttgaggtttcgggttttgccatttttgtgagtttttgtttcttggtttaatgtgtggattagcaatgtaattatgaacctatgatgtgtgatttggttaagatacttttaaggttatggttatggtagttaccgt

SEQ ID NO: 100 - protein, 132 aa, Gossypium hirsutum
  misc_feature (58)..(132): Pfam Name: RALF Pfam Description: Rapid ALkalinization Factor (RALF)
  misc_feature: Ceres Clone ID no. 1914539
  misc_feature: Bit score of 297.0 for HMM based on sequences of Figure 9
  misc_feature: Functional Homolog Of SEQ ID NO. 77
MASSSLLSKLLLLLFISYIVLWGSKVDAQVEETSLKLMRDALEWPLSVSLYSDLNDNEGEEEVDGEEETGHSRRSLFWTRMRYYISYSALSANRIPCPPRSGRSYYTNNCFKAHGSVHPYSRGCSRITRCRR

SEQ ID NO: 101 - DNA, 756 bp, Glycine max
  misc_feature: Ceres Clone ID no. 668581
  misc_feature: Encodes the peptide sequence at SEQ ID NO. 102
gattaacttcacacttcactctctagtcatggcttcttctcttcctcttctcaaccttcttaccctcgctctgtcactactcttctgcattgccttaacttccgaggttggcgtgcaggcgcagatggaggagacaggcttgaacctcatgtcggaggcgttggagtggccaaccgcaatgtcgctctacgacgaagacagcgaagaagaggatgtccagaacggttacagtcggagatcgttgttctggcggaggatgaagtactacatctcctacggcgctctttccgcgaaccgaatcccgtgcccacctcgttctggtagatcttactacacccacaactgctacagggcccgaggccccgttcacccttactccagaggctgctctgtcatcacgcgctgccggagatgagtgagttcggatctgatcacacgcgcgcctcacgcttcagatcgcaaataaaaaaaaccaccgtctagggtcttgttttgttagtgtactagatttattgtctatttaagcaagtcaaaagtgtcgtgtttcagtaacggttctcgttgcgctgcgctattttcatgaaccatctgtttgcttgctttgtgtgttactttatcatattcattcctttgtataaactcgaatgaactctatacgtggatgcgcaaatctgcttcctatctttgtattcccatcgcttacactctcttacgttgcaaattatgtatcctatctcatttcctttttcctttgtg

SEQ ID NO: 102 - protein, 128 aa, Glycine max
  misc_feature (57)..(128): Pfam Name: RALF Pfam Description: Rapid ALkalinization Factor (RALF)
  misc_feature: Ceres Clone ID no. 668581
  misc_feature: Bit score of 289.7 for HMM based on sequences of Figure 9
  misc_feature: Functional Homolog Of SEQ ID NO. 77
MASSLPLLNLLTLALSLLFCIALTSEVGVQAQMEETGLNLMSEALEWPTAMSLYDEDSEEEDVQNGYSRRSLFWRRMKYYISYGALSANRIPCPPRSGRSYYTHNCYRARGPVHPYSRGCSVITRCRR

SEQ ID NO: 103 - DNA, 639 bp, Gossypium hirsutum
  misc_feature: Ceres Clone ID no. 1914939
  misc_feature: Encodes the peptide sequence at SEQ ID NO. 104
aagccatggcttcttcttcatcagtacttctcagcaagcttattctcccccttttcatcactcacattgtccttacaacctccatagtcgaagctcaagtcgaagatacaagtttgaagctggtcagagatgctttagaaaggccacttccaatctcactttacagtgagttaaacgacgatgaagaagccgatgaagagatagatgatgatgaaggtgaaaatgggtacagtcgaagatctttgttttggaagagaatgaggtattacatttcatacggggcgctttgggctaacaggatcccgtgcccaccaaggtcaggcagatcttattacactcacaactgtttcaaggtccacgggcctgttcatccttacactaggggttgttcaaggatcactcgctgcaggagatgatgagcttgttaggaaaaaaaagggggggatgtaaaatcactaaaatggtgcaagctttgagtgctaagctagctaaaatattatgagtttttggtcttctcattttcttttttattaatgatggattagcaatgtgattgtgaacttattataacgagcattcgtgttcaagtatttgatcatgtgatgggttagaataattagattgcagaagattcaagtt

SEQ ID NO: 104 - protein, 136 aa, Gossypium hirsutum
  misc_feature (64)..(136): Pfam Name: RALF Pfam Description: Rapid ALkalinization Factor (RALF)
  misc_feature: Ceres Clone ID no. 1914939
  misc_feature: Bit score of 301.3 for HMM based on sequences of Figure 9
  misc_feature: Functional Homolog Of SEQ ID NO. 77
MASSSSVLLSKLILPLFITHIVLTTSIVEAQVEDTSLKLVRDALERPLPISLYSELNDDEEADEEIDDDEGENGYSRRSLFWKRMRYYISYGALWANRIPCPPRSGRSYYTHNCFKVHGPVHPYTRGCSRITRCRR

SEQ ID NO: 105 - DNA, 644 bp, Glycine max
  misc_feature: Ceres Clone ID no. 723694
  misc_feature: Encodes the peptide sequence at SEQ ID NO. 106
cacacttcactctctagtcatggcttcttctcttcctcttctcaaccttcttaccctcgctctgtcactactcttctgcattgccttaacttccgaggttggcgtgtaggcgcagatggaggagacaggcttgaacctcatgtcggaggcgttggagtggccaaccgcaatgtcgctctacgacgaagacagcgaagaagaggatgtccagaacggttacagtcggagatcgttgttctggcggaggatgaagtactacatctcctacggcgctctttccgcgaaccgaatcccgtgcccacctcgttctggtagatcttactacacccacaactgctacagggcccgaggccccgttcacccttactccagaggctgctctgtcatcacgcgctgccggagatgagtgagttcggatctgatcacacgcgcgcctcacgcttcagatcgcaaataaaaaaaaccaccgtctagggtcttgttttgttagtgtactagatttattgtctatttaagcaagtcaaaagtgtcgtgtttcagtaacggttctcgttgcgctgcgctattttcatgaaccatctgtttgcttgctttgtgtgttactttatcatattcattcctttgtataaactcgaatgaactcg

SEQ ID NO: 106 - protein, 96 aa, Glycine max
  misc_feature (25)..(96): Pfam Name: RALF Pfam Description: Rapid ALkalinization Factor (RALF)
  misc_feature: Ceres Clone ID no. 723694
  misc_feature: Bit score of 229.2 for HMM based on sequences of Figure 9
  misc_feature: Functional Homolog Of SEQ ID NO. 77
MEETGLNLMSEALEWPTAMSLYDEDSEEEDVQNGYSRRSLFWRRMKYYISYGALSANRIPCPPRSGRSYYTHNCYRARGPVHPYSRGCSVITRCRR

SEQ ID NO: 107 - DNA, 396 bp, Populus balsamifera subsp. trichocarpa
  misc_feature: Ceres Annot ID no. 1456949
  misc_feature: Encodes the peptide sequence at SEQ ID NO. 108
atgggaaattctacattgcaacactatttcaccttgttgatagtcctcttcactatctttcttgctttcagtccaagaatccaggctcaagtcgatgaaacaagcttgaaggcaatgggcgatgcgctagaatggccaatgtccatgtatttcgatgaaagtagtgagcttgatggtggattggtggatcttgatgacggtgaagaaactagtcgtagatctttactttggacgagaacgcattactacatctcatatggagctttgtctgccaatagaattccttgtcctgcaaggtccggtagatcttactatagccacaactgcttcaagtctaggattcctgtcaatccctactcaagagggtgttctaggatcactcgttgccggagatga

SEQ ID NO: 108 - protein, 131 aa, Populus balsamifera subsp. trichocarpa
  misc_feature (59)..(131): Pfam Name: RALF Pfam Description: Rapid ALkalinization Factor (RALF)
  misc_feature: Ceres Annot ID no. 1456949
  misc_feature: Bit score of 272.3 for HMM based on sequences of Figure 9
  misc_feature: Functional Homolog Of SEQ ID NO. 77
MGNSTLQHYFTLLIVLFTIFLAFSPRIQAQVDETSLKAMGDALEWPMSMYFDESSELDGGLVDLDDGEETSRRSLLWTRTHYYISYGALSANRIPCPARSGRSYYSHNCFKSRIPVNPYSRGCSRITRCRR

SEQ ID NO: 109 - DNA, 366 bp, Populus balsamifera subsp. trichocarpa
  misc_feature: Ceres Annot ID no. 1539918
  misc_feature: Encodes the peptide sequence at SEQ ID NO. 110
atgaaggtttcagctctgagtttgattgctgcctccttaacttttctcattgttgttaaagctcaggttgatttaaaggatttcatccaactgacaagtgaagatcttgaatggccatcagcgttgtctgtctacgatgagttaagtgacactgaagacgaagagtatggcggcgggtctcataggaggtctctgcatgggagagcaaagcactattacgtatcatatggtgctctctctgcaaacagggtgccttgcccagctcgctcagggaggtcttactatacccattactgtttccgatcaagaggacaggctaacccctacaccagaggttgctcttgtatcactcactgcaggagataa

SEQ ID NO: 110 - protein, 121 aa, Populus balsamifera subsp. trichocarpa
  misc_feature (50)..(121): Pfam Name: RALF Pfam Description: Rapid ALkalinization Factor (RALF)
  misc_feature: Ceres Annot ID no. 1539918
  misc_feature: Bit score of 197.4 for HMM based on sequences of Figure 9
  misc_feature: Functional Homolog Of SEQ ID NO. 77
MKVSALSLIAASLTFLIVVKAQVDLKDFIQLTSEDLEWPSALSVYDELSDTEDEEYGGGSHRRSLHGRAKHYYVSYGALSANRVPCPARSGRSYYTHYCFRSRGQANPYTRGCSCITHCRR

SEQ ID NO: 111 - DNA, 354 bp, Solanum lycopersicum
  misc_feature: Ceres Annot ID no. 8456138
  misc_feature: Encodes the peptide sequence at SEQ ID NO. 112
atggagtctccaatacttctcttccttatcatcttcttattcacgattggcaaaaatgcagttgttgttgaagcagaagttgatagatttggtttagaacaagtggtgagtgaagattttgagttgccaatgggaatgtcgggtgatgatgagatccagttggatggaaatggaagatctctattgtggaacaaattcaagtactacatttcgtacggagcattatcagctaacagaatcccctgcccaccacggtctggcagatcgtattacacgcaccattgttatcatgctacaggtccagctcatccttacactagaggttgctctgctatcactcgttgccgtagatga

SEQ ID NO: 112 - protein, 117 aa, Solanum lycopersicum
  misc_feature (46)..(117): Pfam Name: RALF Pfam Description: Rapid ALkalinization Factor (RALF)
  misc_feature: Ceres Annot ID no. 8456138
  misc_feature: Bit score of 256.6 for HMM based on sequences of Figure 9
  misc_feature: Functional Homolog Of SEQ ID NO. 77
MESPILLFLIIFLFTIGKNAVVVEAEVDRFGLEQVVSEDFELPMGMSGDDEIQLDGNGRSLLWNKFKYYISYGALSANRIPCPPRSGRSYYTHHCYHATGPAHPYTRGCSAITRCRR

SEQ ID NO: 113 - DNA, 426 bp, Populus balsamifera subsp. trichocarpa
  misc_feature: Ceres Annot ID no. 1486506
  misc_feature: Encodes the peptide sequence at SEQ ID NO. 114
atgaaggtttcagctctgagtttgattgctgcctccttaacttttctcattgttgttaaagctcaggttgatttaaaggatttcatccaactgacaagtgaagatcttgaatggccatcagcgttgtctgtctacgatgagttaagtgacactgaagacgaagagtatggcggcgggtctcataggaggtctctgcatgggagagcaaagcactattacgtatcatatggtgctctctctgcaaacagggtgccttgcccagctcgctcagggaggtcttactatacccattactgtttccgatcaagaggacaggctaacccctacaccagagcatgtgcagagattcagggggcttcacctcttgatttgtccgacactggagaagacaaggaatcgatgcggcgctttagatgctttgattaa

SEQ ID NO: 114 - protein, 141 aa, Populus balsamifera subsp. trichocarpa
  misc_feature (50)..(120): Pfam Name: RALF Pfam Description: Rapid ALkalinization Factor (RALF)
  misc_feature: Ceres Annot ID no. 1486506
  misc_feature: Bit score of 164.5 for HMM based on sequences of Figure 9
  misc_feature: Functional Homolog Of SEQ ID NO. 77
MKVSALSLIAASLTFLIVVKAQVDLKDFIQLTSEDLEWPSALSVYDELSDTEDEEYGGGSHRRSLHGRAKHYYVSYGALSANRVPCPARSGRSYYTHYCFRSRGQANPYTRACAEIQGASPLDLSDTGEDKESMRRFRCFD

SEQ ID NO: 115 - protein, 139 aa, Picea sitchensis
  misc_feature (66)..(136): Pfam Name: RALF Pfam Description: Rapid ALkalinization Factor (RALF)
  misc_feature: Public GI ID no. 116786293
  misc_feature: Bit score of 149.5 for HMM based on sequences of Figure 9
  misc_feature: Functional Homolog Of SEQ ID NO. 77
MGRLGTMLLLVVSLFLMAESLHTALNSQEVTATSNWLGSVASYEQRGFESSAGQICDGALGECNDETEEEFMMDSEAHGRLLRRVRYYISYGALAANRVPCRPRSGRSYYTRNCYAATGPVRPYHRSCTAITRCKRYTS

SEQ ID NO: 116 - DNA, 1296 bp, Arabidopsis thaliana
  misc_feature: Ceres Annot ID no. 1355066
  misc_feature: Encodes the peptide sequence at SEQ ID NO. 117
atgaggctcctcttcagcttctgcttcttcttcttcatgatcatctttaccgcaactgcttatgatccattagatcctagtggtaacattacaatcaaatgggatattatgtcctggacggcagatggctatgtggctacggtaactatgaacaacttccaaatctaccggcacatacaaaaccctggttggacattaggttggacatgggcaaagaaagaggtgatttggtcaatggttggtgcacaaacaacagaacaaggagactgttccaagtttaagggaaatgtacctcattgctgtaagaaaacccctacagttgttgatctcttgccaggtgtgccttataatcaacagttctcaaactgttgcaaaggaggtgtaattggagcttggggtcaagatccatcagccgctgtatcccagtttcaggttagtgctggtttagctggaactacaaacaagactgtcaagcttcctaagaacttcactttgcttggtcccggccctggttacacttgcggtcctgccaaaatcgtgccctctaccgtttttctcacaactgacaaacggcgaaaaacacaagctttgatgacatggaatgttacctgcacatactcacagtttttagcaagaaagcatccaagctgttgtgtctccttctcttctttctacaacgacaccataactccttgcccgtcttgtgcctgtggctgcgagaacaaaaagagctgcgtcaaggctgattctaagattctaaccaagaaaggtctcaacacaccaaaaaaggacaacactcctttgttgcaatgcacacatcacatgtgccctgttagagtccactggcacgttaaaactaactacaaagactattggcgagtgaagatagcaatcacaaatttcaattaccggatgaatcatacactctggactttagcaattcagcatccaaatctcaacaatgtgactcaagttttcagctttgactacaaaccagtctctccttacggatccataaatgatactggaatgttctatggaacgaagttttacaatgatttattaatggaagctggaccttcagggaatgtgcaatcagaggttttgctacagaaagatcaaaagacttttactttcaagcaaggttgggcttttcctagaaaagtttactttaatggtgatgaatgtatgttacctccaccagattcatacccttttctaccaaactctgcacaagggaactttgcttcgttctcactcaccattcttcttctcctattcatctcaatatggtga

SEQ ID NO: 117 - protein, 431 aa, Arabidopsis thaliana
  misc_feature (44)..(208): Pfam Name: Phytochel_synth Pfam Description: Phytochelatin synthetase-like
  misc_feature: Ceres Annot ID no. 1355066
  misc_feature: Bit score of 1139.8 for HMM based on sequences of Figure 3
MRLLFSFCFFFFMIIFTATAYDPLDPSGNITIKWDIMSWTADGYVATVTMNNFQIYRHIQNPGWTLGWTWAKKEVIWSMVGAQTTEQGDCSKFKGNVPHCCKKTPTVVDLLPGVPYNQQFSNCCKGGVIGAWGQDPSAAVSQFQVSAGLAGTTNKTVKLPKNFTLLGPGPGYTCGPAKIVPSTVFLTTDKRRKTQALMTWNVTCTYSQFLARKHPSCCVSFSSFYNDTITPCPSCACGCENKKSCVKADSKILTKKGLNTPKKDNTPLLQCTHHMCPVRVHWHVKTNYKDYWRVKIAITNFNYRMNHTLWTLAIQHPNLNNVTQVFSFDYKPVSPYGSINDTGMFYGTKFYNDLLMEAGPSGNVQSEVLLQKDQKTFTFKQGWAFPRKVYFNGDECMLPPPDSYPFLPNSAQGNFASFSLTILLLLFISIW

SEQ ID NO: 118 - protein, 440 aa, Cleome spinosa
  misc_feature (49)..(213): Pfam Name: Phytochel_synth Pfam Description: Phytochelatin synthetase-like
  misc_feature: Public GI ID no. 90657534
  misc_feature: Bit score of 1163.7 for HMM based on sequences of Figure 3
  misc_feature: Functional Homolog Of SEQ ID NO. 117
MRLSISGFFFFFFFFFSVFIYCTSAYDPLDPNGNVTIKWDVMSWTPDGYVAVVAMNNFQMYRHIPNPGWTLGWTWAKKEVIWSMVGAQTTEQGDCSKFKGNVPHCCKKTPTLVDLLPGVPYNQQFSNCCKGGVVAAWGQDPSASVSQFQVSVGLAGTSNKTVKLPKNFTLLGPGLGYTCGPAKIVPSTIFLTPDKRRKTQALMTWNVTCTYSQFLARKHPSCCVSFSSFYNDTITPCPSCACGCESKKGCVKSDSKILSVKGINTPRKDNAPLLQCTHHMCPVRVHWHVKVNYKDYWRVKIAVTNFNYRMNFSLWTLAIQHPNLNNVTQVFSFDYKPLVPYESINDTGMFYGMKYYNDLLMEAGPFGNVQSEVLLQKDRNTFTFKQGWAFPRKVYFNGDECMLPPPDTYPFLPNSAHGNLSSLWTLPLALLLLLLLISIW

SEQ ID NO: 119 - DNA, 1587 bp, Glycine max
  misc_feature: Ceres Clone ID no. 1237946
  misc_feature: Encodes the peptide sequence at SEQ ID NO. 120
aaaacttttgtcactgaaggtgtcttggagccaattgtagcagttggtaacatcaaacacatattcagacaatgaggcttgtcgtctcagctctttgtgttcttgtgttattctcttgtgcagttgcttatgatcctttggatccaaacggaaacgtaacaatcaaatgggatgtaatgtcttggacaccagatggctatgtggctgtggtaacaatgcacaacttccaaatgtttcggcacatcatgaatcctggatggaccttgggatggacatgggcaaagaaagaagtcatttggtccatgataggagctcaaaccacagaacaaggagattgctctaagttcaaaggcaacatacctcattgctgcaagaaaattcccacagttgtggaccttctccctggtgtaccttacaaccagcaattctcaaactgctgcaagggtggagtagtggcagcatggggccaagatccttcacaagctatctcttccttccaagtgagtgtaggccaagctggtacctcaaacaagacagttaaacttcccaagaacttcactctctttgctccaggaccaggctacacttgtggccctgcaaagattgttccttccaccaattttcttacgcctgacaagcgccgcaagactcaagcactaatgacatggaatgttacctgcacatactcacagtttctggcaagaaagaacccaagttgttgtgtatctttgtcatccttttacaatgaaaccattaccccttgtccctcttgtgcatgtggctgccagaacaagaagcattgtgtcaagggaaactccaaaattctcagcatggtgggggttcacactccaaagaaagacaatgaaccattgctgcagtgcactcatcacatgtgtccaatcagggtccactggcatgtgaagactaactataaggactattggcgagtcaaggttgccataacaaacttcaattacagaatgaatcactccctttggtctcttgctgttcagcatccaaatctcaacaatctcacacaagttttcagtttcaattacaagccacttcttccctatggatccataaatgatactggcatgttctatggcatgaagtacttcaatgatcttctaatggaagctggaccaactgggaatgttcaatcagagttgcttcttcagaaggacaaggatgcattcacattcaagcagggttgggcatttcctcgcaaggtttactttaatggtgatgaatgcatgctgccaccacctgacacctacccttttctccctaactctgctcctgcaagcctacttaacttccctgcgttcatgttgttattgttcttcttgcttgcagtttggtgaattggtgcatattgtgtcagaattttgtgaaatttttgaaaccatgtataccttcttaatggtaacgtgacaataggcatgaatactcaaattctttggaaacactaagccaaatctcatggctgtgttttatctgacatgtgagcaccaaaggggatgctaatatgtaaatctcaacagtgattttgtctgaatcatagattgatgatgctattactcc

SEQ ID NO: 120 - protein, 431 aa, Glycine max
  misc_feature (43)..(207): Pfam Name: Phytochel_synth Pfam Description: Phytochelatin synthetase-like
  misc_feature: Ceres Clone ID no. 1237946
  misc_feature: Bit score of 1142.4 for HMM based on sequences of Figure 3
  misc_feature: Functional Homolog Of SEQ ID NO. 117
MRLVVSALCVLVLFSCAVAYDPLDPNGNVTIKWDVMSWTPDGYVAVVTMHNFQMFRHIMNPGWTLGWTWAKKEVIWSMIGAQTTEQGDCSKFKGNIPHCCKKIPTVVDLLPGVPYNQQFSNCCKGGVVAAWGQDPSQAISSFQVSVGQAGTSNKTVKLPKNFTLFAPGPGYTCGPAKIVPSTNFLTPDKRRKTQALMTWNVTCTYSQFLARKNPSCCVSLSSFYNETITPCPSCACGCQNKKHCVKGNSKILSMVGVHTPKKDNEPLLQCTHHMCPIRVHWHVKTNYKDYWRVKVAITNFNYRMNHSLWSLAVQHPNLNNLTQVFSFNYKPLLPYGSINDTGMFYGMKYFNDLLMEAGPTGNVQSELLLQKDKDAFTFKQGWAFPRKVYFNGDECMLPPPDTYPFLPNSAPASLLNFPAFMLLLFFLLAVW

SEQ ID NO: 121 - protein, 453 aa, Populus balsamifera subsp. trichocarpa
  misc_feature (64)..(228): Pfam Name: Phytochel_synth Pfam Description: Phytochelatin synthetase-like
  misc_feature: Public GI ID no. 118488472
  misc_feature: Bit score of 1150.3 for HMM based on sequences of Figure 3
  misc_feature: Functional Homolog Of SEQ ID NO. 117
MEFDKSAKDCYQSLQRSLLAEMKFIFLIALVFMIVPHAAAYDPLDPNGNITIKWDVMSWTPDGYVATVTMSNFQMYRHIISPGWTLSWSWAKKEVLWSMVGAQTTEQGDCSKFKGNIPHCCKKTPTVVDLLPGVPYNQQFSNCCKGGVMAAWGQDPTASVSAFQVSVGLAGTSNKTVKLPKNFTLLGPGPGYTCGPAKVVPSTVFLTPDRRRKTQALMTWNVTCTYSQFLASKNPTCCVSFSSFYNETITPCPTCACGCQNKNSCVKSNSKESHKKGINTPKKDNTPLLQCTHHMCPIRVHWHVKVNYRDYWRAKVAVTNFNYRMNYTEWTLVVQHPNLNNVTQVFSFDYKPLVPYESINDTGMFYGMKFYNDLLMEAGPFGNVQSEVLLQKDKNTFSLKQGWAFPRKVYFNGDECMLPPPDTYPYLPNSAYANPTSILSMAASLLLILLSMG

SEQ ID NO: 122 - protein, 463 aa, Phaseolus vulgaris
  misc_feature (75)..(239): Pfam Name: Phytochel_synth Pfam Description: Phytochelatin synthetase-like
  misc_feature: Public GI ID no. 38194917
  misc_feature: Bit score of 1144.2 for HMM based on sequences of Figure 3
  misc_feature: Functional Homolog Of SEQ ID NO. 117
MRLVISAAVCVLVLFSYAGEITSTLYAEFASLSFTFHTRPTDFLMFLIVAAYDPLDPNGNVTIKWDVVSWTPDGYVAVVTMSNFQMFRHIMNPGWTLSWSWAKKEVIWSMVGAQTTEQGDCSKFKGNVPHCCKKTPTVVDLLPGVPYNQQFSNCCKGGVVAAWGQDPSSAVSSFQVSIGLAGTSNKTVKLPKNFTLLGPGPGYTCGPAKVVPSTVFLTADKRRKTQALMTWNVTCTYSQFLARKNPGCCVSLSSFYNETITPCPSCACGCQNKRNCIKSDSKRINMVGIHTPKKDNEPLLQCTHHMCPIRVHWHVKLNYMDYWRVKVAVTNFNYRMNYSLWTLAVQHPNLNNVTQVFSFDYKPILPYESINDTGMFYGMKYFNDLLMEAGPTGNVQSEILLQKDKDTFTLKQGWAFPRKVYFNGEECMLPPPDTYPILPNSAPVNLLNFTVFILTMLVMLALW

SEQ ID NO: 123 - protein, 460 aa, Vitis vinifera
  misc_feature (72)..(236): Pfam Name: Phytochel_synth Pfam Description: Phytochelatin synthetase-like
  misc_feature: Public GI ID no. 157341292
  misc_feature: Bit score of 1142.1 for HMM based on sequences of Figure 3
  misc_feature: Functional Homolog Of SEQ ID NO. 117
MRFVISAFFFLMMFSYTGELLDGSQASIRFNFVPLVQFSCSVFVYAAAYDPLDPNGNITIKWDIMSWTPDGYVAVVTMHNFQMYRHIISPGWTLGWTWAKKEVIWSMVGAQTTEQGDCSKFKGNIPHCCKKTPTVVDLLPGVPYNQQFSNCCKGGVVSSWGQDPAASVSAFQVSVGLAGTSNKTVKLPKNFTLLGPGPGYTCGIAKIVPPTNFLTPDRRRKTQALMTWNVTCTYSQLRARKNPSCCVSFSSFYNETITPCPSCACGCQNKNNCVQSDSKLLSMVGINTPRKDNVPLLQCTHHMCPVRVHWHLKINYKDYWRVKVSITNFNYRLNYTLWTLVVQHPNLNNVTQVFSFDYKPLVPYESINDTGMFYGMKFYNDQLMEAGPFGNVQSEVLFQKDNSFTFKQGWAFPRKVYFNGDECMLPLPETYPFLPNSAHQNLLAFSTFISSVIFLLVTVW

SEQ ID NO: 124 - DNA, 1846 bp, Panicum virgatum
  misc_feature: Ceres Clone ID no. 1957107
  misc_feature: Encodes the peptide sequence at SEQ ID NO. 125
acgcaacgcaaccaaccaggcgtcggccagggccgccagccagctgatcgacgcctgcaggtctctctggtggtgacgtgccatctcgatcgatcgattccctcctccttggccggccggccgcccggcctttatttgccggcctcgacgaccttcctctaggaacttgtgctaccagctagcagcagcagtcagtagcggtagtgttcttgctgcggacgcggccggccggctcgacgtccacgatgaggctccgcgactccgccgcgatggtggctctggtgctcgcgctcacctgctccgttgcagtgggctacgatcccctggaccccaacggcaacatcaccatcaagtgggatgtcatctcctggacgcccgacgggtacgtggccatggtgacgatgagcaactaccagatgtaccgccacatcatggcgcccgggtggacggtggggtggtcgtgggccaagaaggaggtgatctggtccatggtcggcgcgcaggccacggagcagggcgactgctccaagttcaaggccggcatcccgcactgctgcaagcgcacccccgccgtcgtcgacctcctcccgggcgtcccctacaaccagcagatcgccaactgctgcaaggccggcgtcgtcgccgcctacggccaggaccctgccgccgccgtctccgccttccaggtctccgtcggcctcgccggcaccaccaacaagacggtcaagctgcccaggaacttcaccctccagggccccggccccggctacacctgcggccccgcccggatcatcccctccaccgtctacctcacccccgaccgccgccgccggacgcaggcgctcatgacctgggcgctcacctgcacctactcgcagcagctcgcctccaagtacccctcctgctgcgtctccttctcctccttctacaacagcaccatcgtgccctgcgcccgctgcgcctgcggctgcggccacggcggccacggcgccgccggctgcatcgccggcgactccaagcgggcgctctcccccggcgtcaacacgccgcgcaaggacggccagccgctgctccagtgcacgccgcacatgtgcccggtgcgcgtccactggcacgtcaagctcaactacaaggactactggcgcgccaagatcgccatcaccaacttcaactaccggatcaactacacgcagtggacgctggtggcgcagcaccccaacctggacaacgtcaccgaggtcttcagcttccagtacaagccgctgctcccctacggcgccatcaacgacaccggcatgttctacgggctcaagttctacaacgacctgctcatggaggccgggcccttcggcaacgtgcagtccgaggtgctcatgcgcaaggacgcaagaaccttcaccttcagccagggctgggcgttcccgcggaagatctacttcaacggcgacgagtgcaagatgccgccgccggactcgtacccctacctgcccaactccgccccgctcgcggctccggtcatcgccaccgcggcctcggcgttcctgctggtggcgctgctcctggtggcgtgatcggtcatgggaattgggatgggctgccagggagcagagtaggcatggcgctctggagactgaaacgcttggcaatgtcatgtgtgttgttgcctgtgcagctgcacatagagagactagcagaccaatcaggctggcagagatcctggcacttttgagtctccaattactttttagacagcctgatcgagaacaaatgatagtatacatagtagagcacaaccttttttctgtggtttcgtcatgtacacataatgcagattattaattgttcg

SEQ ID NO: 125 - protein, 441 aa, Panicum virgatum
  misc_feature (47)..(211): Pfam Name: Phytochel_synth Pfam Description: Phytochelatin synthetase-like
  misc_feature: Ceres Clone ID no. 1957107
  misc_feature: Bit score of 1129.6 for HMM based on sequences of Figure 3
  misc_feature: Functional Homolog Of SEQ ID NO. 117
MRLRDSAAMVALVLALTCSVAVGYDPLDPNGNITIKWDVISWTPDGYVAMVTMSNYQMYRHIMAPGWTVGWSWAKKEVIWSMVGAQATEQGDCSKFKAGIPHCCKRTPAVVDLLPGVPYNQQIANCCKAGVVAAYGQDPAAAVSAFQVSVGLAGTTNKTVKLPRNFTLQGPGPGYTCGPARIIPSTVYLTPDRRRRTQALMTWALTCTYSQQLASKYPSCCVSFSSFYNSTIVPCARCACGCGHGGHGAAGCIAGDSKRALSPGVNTPRKDGQPLLQCTPHMCPVRVHWHVKLNYKDYWRAKIAITNFNYRINYTQWTLVAQHPNLDNVTEVFSFQYKPLLPYGAINDTGMFYGLKFYNDLLMEAGPFGNVQSEVLMRKDARTFTFSQGWAFPRKIYFNGDECKMPPPDSYPYLPNSAPLAAPVIATAASAFLLVALLLVA

SEQ ID NO: 126 - DNA, 1341 bp, Sorghum bicolor
  misc_feature: Ceres Annot ID no. 8640603
  misc_feature: Encodes the peptide sequence at SEQ ID NO. 127
atggggctccgcgactcctccgtgctgctggccgctctgtccctcgcgctcgcctactgctccgtttcagtggtggcctacgatcccctggaccctcggggcaacatcacgataaagtgggacgtgatctcatggacgcccgacgggtacgtggcgatggtgacgatgagcaactaccagatgtaccggcacatcatgtccccgggctggacggtgggctggtcgtgggcgaagaaggaggtgatctggtccatcgtcggcgcgcaggccacggagcagggcgactgctccaagttcaaaggcggcatccctcactgctgcaagcgcacccccgccgtggtcgacctcctccccggggtgccctacaaccagcagatcgccaactgctgcaaggccggcgtcgtgtcggcgtacggccaggaccaggccggctccgtctccgcgttccaggtctccgtcggcctcgccggcaccaccaacaagacggtcaagctccccaagaacttcaccctcatgggtccggggccagggtacacctgcgggccggcgaccgtcgtcccgtccaccgtgtactggacgcccgaccaccggcgacggacgcaggcgctcatgacctggaccgtcacctgcacctactcgcagcagctggcgtccaagtacccgtcctgctgcgtctccttctcctccttctacaacgacaccatcgtgccctgcgccaagtgcgcctgcggctgcggccatggcggccacgccggaccgggaggctgcatcgagggggactccaagcgcgcgctgtcgccgggagtgaacacgccgcggaaggacgggcaggcgctgctgcagtgcacgccgcacatgtgccctgtccgtgtgcactggcatgtcaagctcaactacaaggactactggcgcgccaagatcgccatcaccaacttcaactacaggatgaactacacgcagtggacgctggtggcgcagcacccaaacctggacaatgtcaccgaggtcttcagcttccagtacaagccgctgctaccatacggcagcatcaatgacactggcatgttctacgggctcaagttctacaacgattttctgatggaggccgggccgttcgggaacgtgcagtcggaggtgctcatgcgcaaggacgccaggacattcaccttcagccagggatgggccttcccgcgcaagatctacttcaacggcgacgagtgcaagatgccgccgccggactcgtacccgtacctgcccaacgccgcgcccgtcgccgcctcgcagctggtcgtgtccgccgccgcctcagcgttcctactggcgctgctcctggtggcatga

SEQ ID NO: 127 - protein, 446 aa, Sorghum bicolor
  misc_feature (50)..(214): Pfam Name: Phytochel_synth Pfam Description: Phytochelatin synthetase-like
  misc_feature: Ceres Annot ID no. 8640603
  misc_feature: Bit score of 1129.8 for HMM based on sequences of Figure 3
  misc_feature: Functional Homolog Of SEQ ID NO. 117
MGLRDSSVLLAALSLALAYCSVSVVAYDPLDPRGNITIKWDVISWTPDGYVAMVTMSNYQMYRHIMSPGWTVGWSWAKKEVIWSIVGAQATEQGDCSKFKGGIPHCCKRTPAVVDLLPGVPYNQQIANCCKAGVVSAYGQDQAGSVSAFQVSVGLAGTTNKTVKLPKNFTLMGPGPGYTCGPATVVPSTVYWTPDHRRRTQALMTWTVTCTYSQQLASKYPSCCVSFSSFYNDTIVPCAKCACGCGHGGHAGPGGCIEGDSKRALSPGVNTPRKDGQALLQCTPHMCPVRVHWHVKLNYKDYWRAKIAITNFNYRMNYTQWTLVAQHPNLDNVTEVFSFQYKPLLPYGSINDTGMFYGLKFYNDFLMEAGPFGNVQSEVLMRKDARTFTFSQGWAFPRKIYFNGDECKMPPPDSYPYLPNAAPVAASQLVVSAAASAFLLALLLVA

SEQ ID NO: 128 - DNA, 1540 bp, Triticum aestivum
  misc_feature: Ceres Clone ID no. 829440
  misc_feature: Encodes the peptide sequence at SEQ ID NO. 129
gtattctaattttcgccctttaatcagctccatcgatggagctccccaactctatgctcctggctctgttcctcgcgatcacctgctccgtcgcagctgcgtatgatccgctggacccgacgggcaacattacgatcaagtgggacatccagtcatggacgccggacgggtacgtggcgatggtggcgatgaacaactaccagcagtaccgtcagatcatggcgccggggtggacgctggggtggtcgtgggccaagaaggaggtgatctggtccatcgtgggcgcgcaggccacggagcagggcgactgctccaagttcaagggcggcatcccgcactgctgcaagcacacgccctccgtcgtcgacctcctccccggcgtgccctacaaccagcagatcgccaactgctgccgcggcggcgtcgtctccgcctacggccaggacccggccggcgcgctctcggcgttccaggtctccgtggggctcgccggcaccaccaacaagacggtgaagctgcccaaaaacttcacgctcatggggcccgggctcggctacacctgcggccccgccaccgtcgtcccctccaccgtgtactggagcgccgaccaccgccgcaagacgcaggcgctgatgacctggacggtgacctgcacctactcgcagcagctggcgtcgaggtacccgacgtgctgcgtctccttctcctccttctacaacagcacgatcgtgccgtgcgcccggtgcgcgtgcggctgcggcgcgcacaagagcacgggcgggcgcggcggcaagagccacagcgacgggtgcatcgccggcgactccaagcgcgcgctgacccccggggtgaacacgcccaagaaggacggggcgcagctgctgcagtgcaccaaccacatgtgccccatccgcgtgcactggcacgtcaagctcaactacaaggactactggcgcgccaagatcgccgtcaccaacttcaactaccgcatgaactacacgcagtggacgctcgtcgctcagcacccgaacctcaacaacgtcacggaggtcttcagcttccagtacaagccgctcctgccatacggcaacatcaacgacaccggcatgttctacggcctcaagctctacaacgacctgctcatggaggccggcccgttcggcaacgtgcagtcggaggtgctcatgcgcaaggacgacgccaccttcaccttcggtcagggatgggctttcccgcgcaagatctacttcaacggcgatgagtgcaagatgccgccgccggactcgtacccgtacctgcccaactccgcgccgccgcgttcttccatcatcaccgctgctgcctcaacgtgcctggtgttgctgctcctgctcctggcggcgtgatctatatatcctggtgccacaattttcccattttgtaaaagacaacgcactgttgtaggtaggggcattttggtcttgcgagtattttaccttgtacaccaagatggtatgttcaagtgatttcatggtaatccttaagggaaacgttaccttcc

SEQ ID NO: 129 - protein, 449 aa, Triticum aestivum
  misc_feature (46)..(210): Pfam Name: Phytochel_synth Pfam Description: Phytochelatin synthetase-like
  misc_feature: Ceres Clone ID no. 829440
  misc_feature: Bit score of 1116.3 for HMM based on sequences of Figure 3
  misc_feature: Functional Homolog Of SEQ ID NO. 117
MELPNSMLLALFLAITCSVAAAYDPLDPTGNITIKWDIQSWTPDGYVAMVAMNNYQQYRQIMAPGWTLGWSWAKKEVIWSIVGAQATEQGDCSKFKGGIPHCCKHTPSVVDLLPGVPYNQQIANCCRGGVVSAYGQDPAGALSAFQVSVGLAGTTNKTVKLPKNFTLMGPGLGYTCGPATVVPSTVYWSADHRRKTQALMTWTVTCTYSQQLASRYPTCCVSFSSFYNSTIVPCARCACGCGAHKSTGGRGGKSHSDGCIAGDSKRALTPGVNTPKKDGAQLLQCTNHMCPIRVHWHVKLNYKDYWRAKIAVTNFNYRMNYTQWTLVAQHPNLNNVTEVFSFQYKPLLPYGNINDTGMFYGLKLYNDLLMEAGPFGNVQSEVLMRKDDATFTFGQGWAFPRKIYFNGDECKMPPPDSYPYLPNSAPPRSSIITAAASTCLVLLLLLLAA

SEQ ID NO: 130 - DNA, 1684 bp, Zea mays
  misc_feature: Ceres Clone ID no. 285169
  misc_feature: Encodes the peptide sequence at SEQ ID NO. 131
attcgccctgcctctagctgctgcttcttccaggatcggggatcggagcttgtgctgctactgctactataccagcgctagctagcagcagccgccggccggctcgcgcaactaaggaagggtcgacatgacgatggggctccgcgtccgcgactcctccgcgctgctggctctggccgtcgcgctcgcctgctgctccgttgcagtggtggcctacgaccccctggacccgaacggcaacatcaccatcaagtgggacgtgatctcgtggacgcccgacgggtacgtggcgatggtgacgatgagcaactaccagatgtaccggcacatcatggcgcccgggtggacgttggggtggtcgtgggccaagaaggaggtgatctggtccatcgtgggggcgcaggccacggagcagggggactgctccaagttcaagggcggcatcccgcactgctgcaagcgcaccccggccgtggtggacctcctcccgggggtgccctacaaccagcagatcgccaactgctgcaaggccggcgtggtgtcggcgtacgggcaggacccggcggggtccgtctccgcgttccaggtctccgtcggcctggccggtaccaccaacaagacggtgaagctgcccaggaacttcacgctcatggggcccgggctgggctacacctgcgggcccgccgccgtggtgccgtccaccgtgtactggacgcccgaccaccggcgccggacgcaggcgctcatgacgtggacggtgacctgcacctactcgcagcagctggcgtcccggtacccgtcctgctgcgtctccttctcctccttctacaacagcaccatcgtgccgtgcgcccggtgcgcgtgcggctgcggcggccacggcggccacgcgggtccgggcggctgcatcgagggggactccaagcgcgcgctgtcggccggggtgaacacgccgcgcaaggacggccaggcgctgctgcagtgcacgccgcacatgtgccccatccgggtgcactggcacgtcaagctcaactacaaggactactggcgcgccaagatcgccatcaccaactacaactacaggatgaactacacgcagtggacgctggtggcgcagcaccccaacctggacaacgtcaccgaggtcttcagcttccagtacaagccgctgcaaccatacgggagcatcaatgacactggcatgttctacgggctcaagttctacaacgactttctcatggaggccggcccgttcggcaacgtgcagtcggaggtgctcatgcgcaaggacgcaaggaccttcaccttcagcatgggctgggcgttcccgcgcaagatctacttcaacggcgacgagtgcaagatgccgccgccggactcctacccctacctgcccaacgccgcgcccgtcgtcgcctcgcagctggtcctgtccgccgccgcctcggcgttcctactgttgctgctcctggtggcatgaccgtgaccgaaccaagggcaaggcctccgttttgttttcccgtctcgtcccgtgggcagggagcagacttcagtaggcagggcattttatttggtttttttgccaaggattcaacacttgggttttcgtcagaggaaaactgtcgtgtatgtagtgtgagttgcaggtcgtcggatccccacgtacaagacaatctttggatcg

SEQ ID NO: 131 - protein, 450 aa, Zea mays
  misc_feature (53)..(217): Pfam Name: Phytochel_synth Pfam Description: Phytochelatin synthetase-like
  misc_feature: Ceres Clone ID no. 285169
  misc_feature: Bit score of 1123.0 for HMM based on sequences of Figure 3
  misc_feature: Functional Homolog Of SEQ ID NO. 117
MTMGLRVRDSSALLALAVALACCSVAVVAYDPLDPNGNITIKWDVISWTPDGYVAMVTMSNYQMYRHIMAPGWTLGWSWAKKEVIWSIVGAQATEQGDCSKFKGGIPHCCKRTPAVVDLLPGVPYNQQIANCCKAGVVSAYGQDPAGSVSAFQVSVGLAGTTNKTVKLPRNFTLMGPGLGYTCGPAAVVPSTVYWTPDHRRRTQALMTWTVTCTYSQQLASRYPSCCVSFSSFYNSTIVPCARCACGCGGHGGHAGPGGCIEGDSKRALSAGVNTPRKDGQALLQCTPHMCPIRVHWHVKLNYKDYWRAKIAITNYNYRMNYTQWTLVAQHPNLDNVTEVFSFQYKPLQPYGSINDTGMFYGLKFYNDFLMEAGPFGNVQSEVLMRKDARTFTFSMGWAFPRKIYFNGDECKMPPPDSYPYLPNAAPVVASQLVLSAAASAFLLLLLLVA

SEQ ID NO: 132 - protein, 471 aa, Picea sitchensis
  misc_feature (69)..(234): Pfam Name: Phytochel_synth Pfam Description: Phytochelatin synthetase-like
  misc_feature: Public GI ID no. 116790012
  misc_feature: Bit score of 1051.6 for HMM based on sequences of Figure 3
  misc_feature: Functional Homolog Of SEQ ID NO. 117
MMEKRELNSSRGQRCMQNCHILNKNAAGFFLALTILAIAFSPAGAYDPLDPNGNITIKWDIVSWTADGYVAAVTMHNFQQYRHIPSPPGWTLGWNWAKKEVIWAVVGGQTTEQGDCSKWKAGSPHCCKKDPTVVDLLPGVPYNQQFTNCCKGGALASWAQDPPNSVASFQVSVGNSGTTNKTVKLPKNFTLKAPGPGYTCGPAKIVKSSLFFSTDRRRTTQALMTWNVTCTYSQFLAQKSSTCCVSLSSFYNDTITPCPTCACACRNNVTQPSCVHSDSPVLKLPGPTNPITNSLQPPLLQCTRHMCPVRVHWHVKLNYKDYWRVKITVTNFNYRMNYTDWTLVAQHPNFDNVTQVFSFNYKPLTPYGSINDTAMFWGQKYYNDLLMQAGPMGSVQSELLLRKDKQTFTFKQGWAFPRRLYFNGDQCVMPSPDAYPWLPSTAHPAPAPPSLFAFILPLALALAIVPSLFLP

SEQ ID NO: 133 - protein, 462 aa, Vitis vinifera
  misc_feature (74)..(238): Pfam Name: Phytochel_synth Pfam Description: Phytochelatin synthetase-like
  misc_feature: Public GI ID no. 157356290
  misc_feature: Bit score of 1096.4 for HMM based on sequences of Figure 3
  misc_feature: Functional Homolog Of SEQ ID NO. 117
MEFNNSANPVHHTPFEAKDRCQWQDCYSFRELKHIFSVVIFFMMVSHAIAYDPLDPTGNITIKWDVVSWTPDGYVALVTMNNFQMYRHIMTPGWTLSWSWAKKEVIWSMVGAQTTEQGDCSKFKANIPHCCEKTPTVVDLLPGVPYNQQIANCCKAGVVAAWGQDPAGSVSSFQVSVGQAGTSNKTVKLPKNFTLLGPGPGYTCGPAKIVPSTIYLTPDHRRKTQAMMTWNVTCTYSQFLASKNPTCCVSFSSFYNDTMTPCPSCACGCRNKNMCISSDSKKLKALHNPKRSNTPLLQCTHHMCPIRVHWHVKLNYKDYWRVKIAITNFNYRMNYTQWTLVAQHPNLNNVTQVFSFDYKPLVPYESINDTGMFYGMKFYNDLLVEAGQHGNVQSEVLLQKNKDTFTFKQGWAFPRKVYFNGDECKLPPPDTYPFLPNSAHANPFAFWTMAAPLLLMILYTIW

SEQ ID NO: 134 - DNA, 1296 bp, Populus balsamifera subsp. trichocarpa
  misc_feature: Ceres Annot ID no. 1450186
  misc_feature: Encodes the peptide sequence at SEQ ID NO. 135
atgagatttctcttctttattgtcttgtttcttgtgctcttttcttgttcaggtgcatatgatcctttggatccaactggaaatgtaacaataaaatgggatattatgtcttggacgacagatggctatattgcaattgtaacattgttcaacttccaaacgttccggcacttcatgaaacctggatggaccataggctggacatgggcaaagaaagaaatcatatggtccatcaatggtgctcaagcggttgaacaaggcgactgctccaagttcaaagcaaacatacctcattcctgcaagagaagccctgcagttgtggacttgcttcccggtgctcctttcaaccagcaattcggtaattgttgcaaaggcggagtagtggcagcatggggcaaagatccttcagctgctgtctctcaatttcagattactgttggattatccggtacttcaaataaaacagtgaaacttccaaagagcttcaccttgttaggtccaggaccaggatacacttgtggccctccaaagatggtgccttccaccaagtttcttactcctgatggtctgcgaagaactcaggccctgttgacttggaatgttacctgcacttactcacaattcatggcaagaaaaaacccaagttgctgtgtatctctttcatctttctacaatcagatactcactccctgcccaacttgtgcgtgcggttgccaaaacaatgacacttgtgtcaatggcgattccagaattcttcaattgccggtaggaaacacaacccggaaagataatagctctcttctgcaatgcacacaccatatgtgcccggttcgagtgcactggcatgtgaaggtgaactataaggagtactggcgtgtcaagattgcgatcacaaatttcaactacatgaagaactactcgacttggaccctcgttgtacagcatccgaatctcaacaacgtaacgcaagtttttagcttcgagtacaaacctctcattgcctatgactcgataaatgacacagggatgttctatggcatgaaggactacaatgacgtattaatggaagcagggccacttggaaatcttcaatctgaggtgcttcttcagaaggaccagaacactttcaccttcaagcagggatgggcatttccacggaaagtctacttcaatggcgatgagtgcatggtacccccgccagatacatacccatttctgcccaattctgctcatggatccccacacttctccatgttgatttctacgttgattttcctgttcgtgtatatctggtaa

SEQ ID NO: 135 - protein, 431 aa, Populus balsamifera subsp. trichocarpa
  misc_feature (43)..(207): Pfam Name: Phytochel_synth Pfam Description: Phytochelatin synthetase-like
  misc_feature: Ceres Annot ID no. 1450186
  misc_feature: Bit score of 992.2 for HMM based on sequences of Figure 3
  misc_feature: Functional Homolog Of SEQ ID NO. 117
MRFLFFIVLFLVLFSCSGAYDPLDPTGNVTIKWDIMSWTTDGYIAIVTLFNFQTFRHFMKPGWTIGWTWAKKEIIWSINGAQAVEQGDCSKFKANIPHSCKRSPAVVDLLPGAPFNQQFGNCCKGGVVAAWGKDPSAAVSQFQITVGLSGTSNKTVKLPKSFTLLGPGPGYTCGPPKMVPSTKFLTPDGLRRTQALLTWNVTCTYSQFMARKNPSCCVSLSSFYNQILTPCPTCACGCQNNDTCVNGDSRILQLPVGNTTRKDNSSLLQCTHHMCPVRVHWHVKVNYKEYWRVKIAITNFNYMKNYSTWTLVVQHPNLNNVTQVFSFEYKPLIAYDSINDTGMFYGMKDYNDVLMEAGPLGNLQSEVLLQKDQNTFTFKQGWAFPRKVYFNGDECMVPPPDTYPFLPNSAHGSPHFSMLISTLIFLFVYIW

SEQ ID NO: 136 - DNA, 1576 bp, Panicum virgatum
  misc_feature: Ceres Clone ID no. 1804732
  misc_feature: Encodes the peptide sequence at SEQ ID NO. 137
aaccaaatgcggcgtcctgctggtgtggtctagcgagccgcgtggtgcttgggctccgttcgttccgttgaggctcgcgtcgatctagcgatggagccccggtgctccgtgatggtcctggccctcgccgccgcgctatccgtcgcagtggcttacgacccgctggacccgaacgggaacattaccatcaaatgggacatcatgtcgtggacgcctgacggctatgtcgcggtggtgacgatcaacaacttccagatgtaccggcagatcatggcgccggggtggacggtggggtggacgtgggccaagaaggaggtgatctggtccatggtgggcgcgcaggccacggagcagggcgactgctcccgcttcaagggcaacatcccgcactgctgcaagcgcacccccgccgtcgtggacctgctgcccggcgtgccctacaaccagcagatcgccaactgctgccggggcggcgtcatcagcgcctacggccaggaccccggcgccgccgtcgccgcgttccaggtcagcgtcggccaggccggcaccaccaaccgcaccgtcaaggtgcccaagaacttcacgctgctcggccccggccctgggtacacctgcggccccgccaaggtcgtcccctccaccgtcttcctcacgcccgaccgccgccgcaagacccaggcactcatgacgtggaacgtgacgtgcacctactcgcagtacctggcgtccaagtacccgtcctgctgcgtctctttctcctccttctacaacgacaccatcgtgccctgcgccaagtgcgcctgcggctgcgagcacaagacctgcgtccagggcgactcgaagcggccgctggcggtgacggggaagcacacgcacgcggcggcgacgcgcgggcaccgggacaaggaggcgccgctgctgcagtgcacgacgcacatgtgccccgtgcgcgtgcactggcacgtcaagctcaactacaaggagtactggcgcgccaagatcgccatcaccaacttcaactaccgcatgaactacacgcagtggacgctcgtcgcgcagcaccccaacctcgacaacatcaccgaggtcttcagcttcgactacaagcccgtcgttgcctacggatccatcaatgacacggccatgttctacgggctcaagtacttcaacgaccacctcatgcaggcggggccgtacgggaacgtgcagtcggaggtgctcatgcgcaaggacgccagcaccttcaccttcaggcagggctgggcgttcccgcgcaaggtctacttcaacggcgatgagtgccagatgccgccgccggacgcctacccctacctgcccaacgccgccctgccggcccccgtggcgtcgctgggcgccgcggtggtggccgtcgtggcgttcctggtgctggtcgtggtatgagacatgagaaaaacacaggagagcgatcgacctagcgctagaatcggccggcatggggagaaaaagacgacgatgttttgctctgtagatacagtcgacgttttgacttttgagtttcaggattggtttggatatctaagtttttttttctttc

SEQ ID NO: 137 - protein, 443 aa, Panicum virgatum
  misc_feature (45)..(209): Pfam Name: Phytochel_synth Pfam Description: Phytochelatin synthetase-like
  misc_feature: Ceres Clone ID no. 1804732
  misc_feature: Bit score of 1050.0 for HMM based on sequences of Figure 3
  misc_feature: Functional Homolog Of SEQ ID NO. 117
MEPRCSVMVLALAAALSVAVAYDPLDPNGNITIKWDIMSWTPDGYVAVVTINNFQMYRQIMAPGWTVGWTWAKKEVIWSMVGAQATEQGDCSRFKGNIPHCCKRTPAVVDLLPGVPYNQQIANCCRGGVISAYGQDPGAAVAAFQVSVGQAGTTNRTVKVPKNFTLLGPGPGYTCGPAKVVPSTVFLTPDRRRKTQALMTWNVTCTYSQYLASKYPSCCVSFSSFYNDTIVPCAKCACGCEHKTCVQGDSKRPLAVTGKHTHAAATRGHRDKEAPLLQCTTHMCPVRVHWHVKLNYKEYWRAKIAITNFNYRMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDAYPYLPNAALPAPVASLGAAVVAVVAFLVLVVV

SEQ ID NO: 138 - DNA, 1566 bp, Panicum virgatum
  misc_feature: Ceres Clone ID no. 1781794
  misc_feature: Encodes the peptide sequence at SEQ ID NO. 139
caggaacttgtcccaccagctagcagtcagtagcggtgttcttgcagaggcggccggccggctcgacgtgcgtcgacgatggggctccgccgcgactccgccgccgcgctggtggctctggtgctcgcggtcacctgctgctccgttgcagtagtggcctacgatcccctggacccgaacggcaacatcaccatcaagtgggacgtcatctcctggacgcccgacggctacgtggcgatggtgacgatgagcaactaccagatgtaccggcacatcatggcgcccgggtggacggtggggtggtcgtgggccaagaaagaggtgatctggtccatcgtgggcgcgcaggccacggagcagggcgactgctccaagttcaaggccggcatcccgcactgctgcaagcgcacccccgccgtggtggacctcctcccgggcgtaccctacaaccagcagatcgccaactgctgcaaggccggcgtcgtcgccgcctacggccaggaccccaccgccgccgtctccgccttccaggtctccgtcggcctcgccggcaccaccaacaagaccgtcaagctccccaccaacttcaccctccagggccccggcccgggctacacctgcggccccgcccgcgtcgtcccctccaccgtctacctcacccccgaccgccgccgccgcacgcaggcgctcatgacctggaccgtcacctgcacctactcccagcagctcgcctcccggtacccctcctgctgcgtctccttctcctccttctacaacagcaccatcgtgccctgcgcccactgcgcctgcggctgcggccatggcggccacggcggcgccggctgcatcgccggcgactccaagcgcgcgctctcccccggcgtcaacacgccgcgcagggacgggcagccgctgctgcagtgcacgccgcacatgtgcccggtgcgcgtccactggcacgtcaagctcaactacaaagactactggcgcgccaagatcgccatcaccaacttcaactaccggatcaactacacgcagtggacgctggtggcgcagcaccccaacctggacaacgtcaccgaggtcttcagcttccagtacaggccgctgctgccctacggcgccatcaacgacaccggcatgttctacgggctcaaattctacaacgacctgctcatggaggccgggcctttcggcaacgtgcagtccgaggtgctcatgcgcaaggacgccagaaccttcaccttcagccagggatgggccttcccaaggaagatctacttcaacggcgacgagtgcaagatgccgccgccggactcctacccctacctgcccaacaggtccgcccgggttgcggcaccgtcggtgatcgcctcggcattcctgctggcgctgctgctcctgctggcgccgtgattgatagggagcagcagagtgtgttgttacctgtgcagcggtggtttcgtcatgtaaacataacgcggtgggatctccaattactttctagacagcctgagaacaaatgatagtaatacatagtagagcacaagcctttttctgcggttt

SEQ ID NO: 139 - protein, 445 aa, Panicum virgatum
  misc_feature (51)..(215): Pfam Name: Phytochel_synth Pfam Description: Phytochelatin synthetase-like
  misc_feature: Ceres Clone ID no. 1781794
  misc_feature: Bit score of 1098.5 for HMM based on sequences of Figure 3
  misc_feature: Functional Homolog Of SEQ ID NO. 117
MGLRRDSAAALVALVLAVTCCSVAVVAYDPLDPNGNITIKWDVISWTPDGYVAMVTMSNYQMYRHIMAPGWTVGWSWAKKEVIWSIVGAQATEQGDCSKFKAGIPHCCKRTPAVVDLLPGVPYNQQIANCCKAGVVAAYGQDPTAAVSAFQVSVGLAGTTNKTVKLPTNFTLQGPGPGYTCGPARVVPSTVYLTPDRRRRTQALMTWTVTCTYSQQLASRYPSCCVSFSSFYNSTIVPCAHCACGCGHGGHGGAGCIAGDSKRALSPGVNTPRRDGQPLLQCTPHMCPVRVHWHVKLNYKDYWRAKIAITNFNYRINYTQWTLVAQHPNLDNVTEVFSFQYRPLLPYGAINDTGMFYGLKFYNDLLMEAGPFGNVQSEVLMRKDARTFTFSQGWAFPRKIYFNGDECKMPPPDSYPYLPNRSARVAAPSVIASAFLLALLLLLAP

SEQ ID NO: 140 - DNA, 1341 bp, Sorghum bicolor
  misc_feature: Ceres Annot ID no. 8656625
  misc_feature: Encodes the peptide sequence at SEQ ID NO. 141
atggagccccgatgcttcgtgctggtcctggccctcgccgccgcgctctccgtcgcagtggcttacgacccgttggacccgaacgggaacattaccatcaaatgggacatcatgtcgtggacgcctgacggctatgtcgcggtggtgaccatcaacaacttccagatgtaccggcagatcatggcgccggggtggacggtggggtggacgtgggcgaagcgtgaggtgatctggtccatggtgggcgcgcaggcgacggagcagggcgactgctcccgcttcaaggccaacatcccgcactgctgcaagcgcacgcccaccgtcgtcgacctgctccccggcgtgccctacaaccagcagatcgccaactgctgccgcggcggcgtcatcagcgcctacggccaggacccggcctccgccgtcgccgcgttccaggtcagcgtcggccaggccggcaccaccaaccgcaccgtcaaggttcccaagaacttcacgctgcttgggccagggccagggtacacctgcggccccggcaagattgttccctccaccgtcttcctcacgcccgaccgccggcgcaagacacaagccctcatgacgtggaacgtgacgtgcacctactcgcagcacctggcgtccaagtacccgtcctgctgcgtctccttctcctccttctacaacgacaccatcgtgccctgcgccaagtgcgcctgcggctgcgagcacaagacctgcgtccagggcgactcgaagcggctggcggtgacggggaagcacgagcacgcgcacgcggcggcggcgcgcgggcacagggacaaggaggcgccgctgctgcagtgcacgacgcacatgtgccccgtgcgcgtgcactggcacgtcaagctcaactacaaggagtactggcgggccaagatcgccatcaccaacttcaactaccacatgaactacacgcagtggacgctcgtcgcgcagcaccccaacctcgacaacatcaccgaggtcttcagcttcgactacaagcctgtcgtcgcctacggatccatcaatgacacggcgatgttctacgggctcaagtacttcaacgaccacctgatgcaggcggggccgtacgggaacgtgcagtcggaggtgctgatgcgcaaggacgccagcaccttcaccttcaggcagggctgggcgttcccgcgcaaggtctacttcaacggcgacgagtgccagatgccgccgccggacgagtatccctacttgcccaactcagccctgccggcagccgcggcgtcgtcgtcgctgggcgctgcggtagcggccgtcgtggtgctcttggtgatgatcgtggcatga

SEQ ID NO: 141 - protein, 446 aa, Sorghum bicolor
  misc_feature (45)..(209): Pfam Name: Phytochel_synth Pfam Description: Phytochelatin synthetase-like
  misc_feature: Ceres Annot ID no. 8656625
  misc_feature: Bit score of 1042.9 for HMM based on sequences of Figure 3
  misc_feature: Functional Homolog Of SEQ ID NO. 117
MEPRCFVLVLALAAALSVAVAYDPLDPNGNITIKWDIMSWTPDGYVAVVTINNFQMYRQIMAPGWTVGWTWAKREVIWSMVGAQATEQGDCSRFKANIPHCCKRTPTVVDLLPGVPYNQQIANCCRGGVISAYGQDPASAVAAFQVSVGQAGTTNRTVKVPKNFTLLGPGPGYTCGPGKIVPSTVFLTPDRRRKTQALMTWNVTCTYSQHLASKYPSCCVSFSSFYNDTIVPCAKCACGCEHKTCVQGDSKRLAVTGKHEHAHAAAARGHRDKEAPLLQCTTHMCPVRVHWHVKLNYKEYWRAKIAITNFNYHMNYTQWTLVAQHPNLDNITEVFSFDYKPVVAYGSINDTAMFYGLKYFNDHLMQAGPYGNVQSEVLMRKDASTFTFRQGWAFPRKVYFNGDECQMPPPDEYPYLPNSALPAAAASSSLGAAVAAVVVLLVMIVA

SEQ ID NO: 142 - protein, 447 aa, Zea mays
  misc_feature (47)..(211): Pfam Name: Phytochel_synth Pfam Description: Phytochelatin synthetase-like
  misc_feature: Public GI ID no. 162462515
  misc_feature: Bit score of 1036.7 for HMM based on sequences of Figure 3
  misc_feature: Functional Homolog Of SEQ ID NO. 117
MEPRRSVLLLALAVAAALSVAVAYDPLDPNGNITIKWDIMSWTPDGYVAVVTINNFQTYRQITAPGWTVGWTWAKREVIWSMVGAQATEQGDCSRFKANIPHCCKRTPAVVDLLPGVPYNQQIANCCRGGVVSAYGQDPATAVAAFQVSVGQAGTTNRTVKVPKNFTLLGPGPGYTCGPGKVVPSTVFLTPDRRRKTQALMTWNVTCTYSQHLASKYPSCCVSFSSFYNDTIVPCAKCACGCEHKTCVQGDSKRLAVTGKHAHTAAAVRGQHRDKEAPLLQCTTHMCPVRVHWHVKLNYKEYWRAKIAITNFNYHMNYTQWTLVAQHPNLDNITEVFSFGYKPVVSYGSINDTAMFYGLKYFNDHLMQAGPYGNVQSEVLMRKDASTFTFRQGWAFPRKVYFNGDECQMPPPDAYPYLPNSAPPTAAASLGGAAAAAVVVLLGMIVA

SEQ ID NO: 143 - DNA, 1529 bp, Sorghum bicolor
  misc_feature: Ceres Clone ID no. 570485
  misc_feature: Encodes the peptide sequence at SEQ ID NO. 144
atctgcgccttctggtgagagtacgtgtgttggttgttcttgcaggcacttgcacgcgtggtcaccatggagctgccccacgccgcgctcgcgctgatcgtcgccgcggccgccacgctctccgtcgcagtggcctacgacccgctggatcccaacgggaacatcaccatcaaatgggacgttctctcgtggacgccagacggatacgtcgcgacggtgacgatcaacaacttccagacgtaccggcagatcatggcgccggggtggacggtggggtggacgtgggcgaagcgggaggtgatctggtccatggtgggcgcgcaggccacggagcagggcgactgctccaagttcaaggccaacctcccgcactcgtgcaagcgcacccccgccgtcgtcgacctgctcccgggcgtgccctacaaccagcagatcgccaactgctgccgcggcggcgtcgtctccgcctacggccaggacccgtccggcgccgtgtcctccttccaggtcagcgtcggccaggccggcaccaccaaccgcaccgtcaaggtccccaagaacttcaccctcctcggccccggcccaggctacacctgcggccccgccaaggtcgtcccctccaccgtcttcctcaccgccgaccaccgccgcaagacccaggccctcatgacgtggaacgtgacgtgcacctactcgcagcacctggcgtccaagtacccgacctgctgcgtctccttctcctccttctacaacgacaccatcgtgccctgcgccaagtgcgcgtgcggctgcgagcacaagacctgcgcccgcagcgagcgggactcgaagcggctcatgtcggcgtcggggaagagcagcgcgcacgcggtcaccgcggtgcgcgggcacgtgaaccggcagagcgcggcgccgctgctgcagtgcacgacccacatgtgccccgtgcgcgtccactggcacgtcaagctcaactaccacgactactggcgcgccaaggtgaccgtcaccaacttcaactaccgcaccaactacaccggctggacgctcgtcgcccagcaccccaacctcgacaacatcaccgaggtcttcagcttcgactacaagcccgtcgtctcctacggctccatcaatgatacggcgctgttctacgggatgaagttcttcaacgaccagctcatggaggcggggccgtacgggaacgtgcagtcggaggtgctgatgcgcaaggacgccagcacattcacgttcaggcaggggtgggcgttcccgcggaagatctacttcaacggcgacgagtgccggatgccgccgccggactcctacccttacctgcccaactccgcgccggcgtcgctcgtgagctccgcctccgtcgtcgtcgccttcttggttctactcatggcatgagcgtcggaggcggccatgatgttttgcctgtagatcataggagaacgttttgggcttcaaggttgagatcggtggtgttttaatctggatataattaaacgcaagtttttccccattac

SEQ ID NO: 144 - protein, 447 aa, Sorghum bicolor
  misc_feature (47)..(211): Pfam Name: Phytochel_synth Pfam Description: Phytochelatin synthetase-like
  misc_feature: Ceres Clone ID no. 570485
  misc_feature: Bit score of 1016.9 for HMM based on sequences of Figure 3
  misc_feature: Functional Homolog Of SEQ ID NO. 117
MELPHAALALIVAAAATLSVAVAYDPLDPNGNITIKWDVLSWTPDGYVATVTINNFQTYRQIMAPGWTVGWTWAKREVIWSMVGAQATEQGDCSKFKANLPHSCKRTPAVVDLLPGVPYNQQIANCCRGGVVSAYGQDPSGAVSSFQVSVGQAGTTNRTVKVPKNFTLLGPGPGYTCGPAKVVPSTVFLTADHRRKTQALMTWNVTCTYSQHLASKYPTCCVSFSSFYNDTIVPCAKCACGCEHKTCARSERDSKRLMSASGKSSAHAVTAVRGHVNRQSAAPLLQCTTHMCPVRVHWHVKLNYHDYWRAKVTVTNFNYRTNYTGWTLVAQHPNLDNITEVFSFDYKPVVSYGSINDTALFYGMKFFNDQLMEAGPYGNVQSEVLMRKDASTFTFRQGWAFPRKIYFNGDECRMPPPDSYPYLPNSAPASLVSSASVVVAFLVLLMA

SEQ ID NO: 145 - protein, 441 aa, Oryza sativa subsp. japonica
  misc_feature (46)..(210): Pfam Name: Phytochel_synth Pfam Description: Phytochelatin synthetase-like
  misc_feature: Public GI ID no. 125586664
  misc_feature: Bit score of 1075.6 for HMM based on sequences of Figure 3
  misc_feature: Functional Homolog Of SEQ ID NO. 117
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCASRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 146 - protein, 458 aa, Picea sitchensis
  misc_feature (63)..(227): Pfam Name: Phytochel_synth Pfam Description: Phytochelatin synthetase-like
  misc_feature: Public GI ID no. 116788824
  misc_feature: Bit score of 967.3 for HMM based on sequences of Figure 3
  misc_feature: Functional Homolog Of SEQ ID NO. 117
MGFSDTNTNMRVQSRWCFTSGILLGLTLIIAFAFSPTGAYDPLDPNGNITIKWDIMSWTPDGYLAVVTINNFQQYRHIQSPGWTLGWTWAKKEVIWSMVGAQTTEQGDCSKYKGNIPHCCNKNPTVVDLLPGTPYNQQIANCCKGGVIASWAQDPVNAVSAFQVSVGNAGTTNTTVRLPKNFTLKAPGPGYTCGPAKKVRASKFLTTDGRRVTQALMTWNITCTYSQFLAQKTPSCCVSLTSFYNDTIVPCPACTCGCQNNITQPGTCVESDSPVLPSLLNTSPKNLAPLIQCTPHMCPIKIHWHVKLNYKEYWRVKVTITNFNYRMNYTQWNIVVQHPNFDNVTQLFSFNYKPLTPYGKINDTAMLWGVKYYNDMLMQAGEMGNVQSELLFQKDKQTFTFKQGWGFPRRVYFNGDDCVLPPPDAYPWLPNGSPSPRVGKVFLLIVSLVVSACLLAFL

SEQ ID NO: 147 - protein, 468 aa, Oryza sativa subsp. japonica
  misc_feature (46)..(210): Pfam Name: Phytochel_synth Pfam Description: Phytochelatin synthetase-like
  misc_feature: Public GI ID no. 115453531
  misc_feature: Bit score of 1101.6 for HMM based on sequences of Figure 3
  misc_feature: Functional Homolog Of SEQ ID NO. 117
MELHRCSLLALLLAVTCSVAVAYDPLDPKGNITIKWDVISWTPDGYVAMVTMSNYQMYRQILAPGWTVGWSWAKKEVIWSIVGAQATEQGDCSKFKGGIPHSCKRTPAIVDLLPGVPYNQQIANCCKAGVVSAYGQDPAGSVSAFQVSVGLAGTTNKTVKLPTNFTLAGPGPGYTCGPATIVPSTVYLTPDRRRRTQALMTWTVTCTYSQQLASRYPTCCVSFSSFYNSTIVPCARCACGCGHDGYRGNGGGGKNARAGDGRSRRNSGGGGGHSGGTECIMGDSKRALSAGVNTPRKDGAPLLQCTSHMCPIRVHWHVKLNYKDYWRAKIAITNFNYRMNYTQWTLVAQHPNLNNVTEVFSFQYKPLLPYGNINDTGMFYGLKFYNDLLMEAGPFGNVQSEVLMRKDYNTFTFSQGWAFPRKIYFNGDECKMPPPDSYPYLPNSAPIGPPRSVAAAASAILVVLLLVA

SEQ ID NO: 148 - DNA, 1715 bp, Arabidopsis thaliana
  misc_feature: Ceres Clone ID no. 17250
  misc_feature: Encodes the peptide sequence at SEQ ID NO. 149
aaaaaatgtctcattgcttctctcgttctaaaaaaaatcttgctgctatctctctataagtccactcctccttcaagcaaagcaccttcctcttctttttgctcctctgagattggtttaagattaaaccagacccatctaagggatctggaacaagcttcgtctctggttccactctgatcatcagagtattaaaaatggagtctttcttctccagatccacctccatcgtctccaaattgagtttcttggccttatggatcgtcttcttgatttcttcatcttcttttacttcgacagaagcatatgatgcgcttgatccagaaggcaacattacaattaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaatctcggatttacggttttgccactggtttgcttagggttacggtggagtggtataaacgtttatttatgattcttttgtgtcccacaaaaattataatcttttgatactttttaaaaatataaatagttttcaacttccttgttttt

SEQ ID NO: 149 - protein, 456 aa, Arabidopsis thaliana
  misc_feature (60)..(224): Pfam Name: Phytochel_synth Pfam Description: Phytochelatin synthetase-like
  misc_feature: Ceres Clone ID no. 17250
  misc_feature: Bit score of 954.5 for HMM based on sequences of Figure 3
  misc_feature: Functional Homolog Of SEQ ID NO. 117
MESFFSRSTSIVSKLSFLALWIVFLISSSSFTSTEAYDALDPEGNITIKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 150 - DNA, 1371 bp, Arabidopsis thaliana
  misc_feature: Ceres Annot ID no. 1363625
  misc_feature: Encodes the peptide sequence at SEQ ID NO. 151
atggagtctttcttctccagatccacctccatcgtctccaaattgagtttcttggccttatggatcgtcttcttgatttcttcatcttcttttacttcgacagaagcatatgatgcgcttgatccagaaggcaacattacaatgaaatgggatgttatgagctggactcctgatggctatgttgccgtggttacgatgttcaacttccagaaatacagacacattcaatctccaggatggacattaggttggaaatgggcaaagaaggaagttatatggagtatggttggagcacaaacaactgaacaaggtgattgttcaaagtacaaaggaaacataccacattgttgtaagaaggatccaacagttgtagacttgcttccagggactccttataatcagcagattgctaattgctgcaagggtggtgttatgaactcatgggttcaagaccctgccactgcggctagctccttccagattagtgttggtgctgctggaaccacaaacaaaaccgttagggtcccaagaaacttcactctcatgggacctggtccaggttacacttgtggtccagcaaagattgtcagaccaacaaaatttgtcacgactgacacacgcagaaccactcaagctatgatgacatggaacattacgtgcacatactcgcagttccttgctcaaagaactccaacttgctgtgtttctttatcttctttctacaatgaaaccattgttggatgtccaacttgtgcttgcggatgtcaaaacaacagaacagaatccggtgcctgcctcgacccggacacaccacacttagcctcggttgtgtcaccaccaacaaagaaaggaacggttttaccaccattagtgcaatgcacgagacacatgtgcccgatcagagtgcattggcatgtaaagcagaactacaaagagtattggcgtgtgaagatcacaatcacaaacttcaactatcgcttgaactacacacaatggaaccttgttgctcaacatccaaatctcgacaacatcactcaaatcttcagcttcaactacaaatctcttactccttacgctggactaaacgatacggcgatgttatggggagtgaagttctacaacgatttcttatcagaagcaggtcctcttgggaatgttcaatcagagattttgttccgtaaagaccaatcaaccttcacattcgagaaaggttgggcttttccacgaaggatttactttaatggagacaattgcgtcatgcctcctccagactcttacccttttcttcccaacggtggttcccggtcacaattctcattcgtcgccgccgtgctcctccctcttcttgtctttttcttcttctctgcctaa

SEQ ID NO: 151 - protein, 456 aa, Arabidopsis thaliana
  misc_feature (60)..(224): Pfam Name: Phytochel_synth Pfam Description: Phytochelatin synthetase-like
  misc_feature: Ceres Annot ID no. 1363625
  misc_feature: Bit score of 951.5 for HMM based on sequences of Figure 3
  misc_feature: Functional Homolog Of SEQ ID NO. 117
MESFFSRSTSIVSKLSFLALWIVFLISSSSFTSTEAYDALDPEGNITMKWDVMSWTPDGYVAVVTMFNFQKYRHIQSPGWTLGWKWAKKEVIWSMVGAQTTEQGDCSKYKGNIPHCCKKDPTVVDLLPGTPYNQQIANCCKGGVMNSWVQDPATAASSFQISVGAAGTTNKTVRVPRNFTLMGPGPGYTCGPAKIVRPTKFVTTDTRRTTQAMMTWNITCTYSQFLAQRTPTCCVSLSSFYNETIVGCPTCACGCQNNRTESGACLDPDTPHLASVVSPPTKKGTVLPPLVQCTRHMCPIRVHWHVKQNYKEYWRVKITITNFNYRLNYTQWNLVAQHPNLDNITQIFSFNYKSLTPYAGLNDTAMLWGVKFYNDFLSEAGPLGNVQSEILFRKDQSTFTFEKGWAFPRRIYFNGDNCVMPPPDSYPFLPNGGSRSQFSFVAAVLLPLLVFFFFSA

SEQ ID NO: 152 - protein, 451 aa, Oryza sativa subsp. japonica
  misc_feature (45)..(209): Pfam Name: Phytochel_synth Pfam Description: Phytochelatin synthetase-like
  misc_feature: Public GI ID no. 75133694
  misc_feature: Bit score of 1006.3 for HMM based on sequences of Figure 3
  misc_feature: Functional Homolog Of SEQ ID NO. 117
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALMTWNVTCTYSQHLASKYPSCCVSFSSFYNDTIVPCAKCACGCDAHKPCVRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 153 - protein, 469 aa, Vitis vinifera
  misc_feature (60)..(224): Pfam Name: Phytochel_synth Pfam Description: Phytochelatin synthetase-like
  misc_feature: Public GI ID no. 147780878
  misc_feature: Bit score of 962.8 for HMM based on sequences of Figure 3
  misc_feature: Functional Homolog Of SEQ ID NO. 117
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRVPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLVQAGPLGNVQSELLFRKDKSTFTFEKGWAFPRRIYFNGDNCVMPPPDSYPWLPNATSRTSTSLLTLIMVLLSALLLYAHGYDNFIGKFYMQYAK

SEQ ID NO: 154 - protein, 456 aa, Vitis vinifera
  misc_feature (60)..(224): Pfam Name: Phytochel_synth Pfam Description: Phytochelatin synthetase-like
  misc_feature: Public GI ID no. 157341291
  misc_feature: Bit score of 964.1 for HMM based on sequences of Figure 3
  misc_feature: Functional Homolog Of SEQ ID NO. 117
MGFCLSLISRSISSFCGCTILLLFLLSCSCFTSTEAYDALDPNGNITIKWDIMSWTPDGYVAVVTMYNFQQYRHIQSPGWSLQWTWAKKEVIWSMLGGQTTEQGDCSRFKGNVPHCCKKDPTVVDLLPGTPYNQQIANCCKGGVVSSWVQDPANAASSFQVSVGSAGTTNKTVRVPKNFTLKAPGPGYTCGPAKIVKPTRFVTQDGRRVTQALMTWNVTCTYSQFLSQKTPTCCVSLSSFYNDTIVPCPTCTCGCQNNITQPGSCVEEDSPYLASVVSGSGKNSYTPLVQCTKHMCPIRVHWHVKLSYKEYWRVKVTITNFNYRMNYTQWNLVVQHPNFDNLTQIFSFNYKSLTPYAAINDTAMLWGVKFYNDLLVQAGPLGNVQSELLFRKDKSTFTFEKGWAFPRRIYFNGDNCVMPPPDSYPWLPNATSRTSTSLLTLIMVLLSALLLLNAHV

SEQ ID NO: 155 - protein, 448 aa, Phaseolus vulgaris
  misc_feature (53)..(217): Pfam Name: Phytochel_synth Pfam Description: Phytochelatin synthetase-like
  misc_feature: Public GI ID no. 38194916
  misc_feature: Bit score of 965.0 for HMM based on sequences of Figure 3
  misc_feature: Functional Homolog Of SEQ ID NO. 117
MGFSLLPKATPCILLLVLLYCTCFTSTDAYDPLDPNGNITIKWDIITWTPDGYVAVVTMNNFQQYRHIASPGWRLGWTWAKKEVIWSMMGGQTTEQGDCSKFKAGIPHCCKKDPTVVDLLPGTPYNQQIANCCKGGVLGSWVQDPTNAVSSFQVSVGRAGTTNKTVKVPKNFTLSAPGPGYTCGPAKIVKPTQFIQADKRRVTQALMTWNVTCQYSQFLAQKTPSCCVSLSSFYNDTIVPCPTCACGCQGNSSLSGSCVNSQTPHLASVVSGSGKNNLSPLVQCTSHMCPVRIHWHVKVNYKEYWRVKVTITNFNYRMNYSEWNMVVQHPNFDNLTQLFSFNYKSLTPYGSINDTAMLWGVKFYNDFLSQAGPNGNVQSELLFRKDKATFTFDKGWAFPRRIYFNGDNCVMPPPDAYPWLPNAGSRQEVSLFALVIAYLVALVFYAHA

SEQ ID NO: 156 - protein, 456 aa, Vitis vinifera
  misc_feature (60)..(224): Pfam Name: Phytochel_synth Pfam Description: Phytochelatin synthetase-like
  misc_feature: Public GI ID no. 157356291
  misc_feature: Bit score of 962.1 for HMM based on sequences of Figure 3
  misc_feature: Functional Homolog Of SEQ ID NO. 117
MEFFFTSIARSITKLSSYAILLVLLFSCSIFTSTEAYDSLDPEGNITIKWDVMSWTPDGYVAVVTMFNFQQYRHIQAPGWSLGWSWAKKEVIWSMMGGQTTEQGDCSRFKGNVPHCCKKDPTVVDLLPGTPYNQQIANCCKGGVINSWVQDPANAASSFQVSVGAAGTTNKTVKLPKNFTLRAPGPGYTCGPAKIVKPTKFTTADQRRVTQALMTWNVTCTYSQFLAQKTPTCCVSLSSFYNNTIVSCPTCTCGCQNNLTHPGSCVDPNNPYLASVVEGSGKTSYQPLVQCTSHMCPIRVHWHVKLNYKDYWRVKITITNFNYRMNYTQWNLVVQHPNFDNLTQIFSFNYKSLTPYAAINDTAMLWGVKFYNDLLSQAGPLGNVQSELLFRKDKATFTFDKGWAFPRRIYFNGDNCVMPPPDAYPWLPNASSRPTVSLLYSILTILAVSVIVLAYA

SEQ ID NO: 157 - DNA, 1834 bp, Gossypium hirsutum
  misc_feature: Ceres Clone ID no. 1883580
  misc_feature: Encodes the peptide sequence at SEQ ID NO. 158
ataatttaaaagaaaaaaggcgttttacagtgagattaaagtgttccactacttaaactcaaagtcttaaactttcgtgtcatgtcctgttggacgaaaaagctactcatctccgttcttctctctgagtcttccctgtctgccacagatcttgaaccgaagtcaataacaaaagaagactcctaaaatcctacagaaatgtctaatctttttttgttcattgctagatctttcttcaacctaagctctttcagcgtcttgcttctgtttttgctctctttctcaagtttcactgcaacagaagcctatgatcctttggatcctaatggaaatatcacaatcaaatgggatatcatgagttggactgctgatggctatgttgcagttgtcacaatctttaacttccagcagtaccgtcacatccaagcaccagggtggacattaggttggaaatggtctaagaaggaggtgatttggagtatgatgggaggacaaacaactgaacaaggggattgttcaagattcaaagggaacattccacattgttgtaagaaggacccaacagtcgtggatttattgccaggaacaccttataatcagcagattgcgaattgctgtaaagggggagtgctaaactcatgggtacaagatccagctacggcagcaagctcattccaggtgagtgtggggcaagctggaactacaaacaagacagttagagttccaaaaaacttcactttgaaggcaccagggcccggttatacttgtggtccagcgaaaattgtgaaacccagtagatttgttaccgcggacaaaagaagagtcacacaagctttgatgacttggaatgttacttgcacgtattcacaatttctagctcagaaaacacctacttgttgcgtctctctctcatcattctataatgaaaccatagtaccttgcccgcaatgtgcttgtggctgccaaaatacttctcagcctgggagctgtgtagaccccaaagctccgcatatagcatcggttgttccaagtacagggaagaataactatgcacctttggtccaatgtacaagtcatatgtgtccggtccgagttcattggcatgttaagctaaactacaaggagtattggcgggttaaggtcacaattactaatttcaattataatatgaactatacacagtggaacttagttgtgcaacatcccaacttcgacaatctcacccagattttcagctttaactacaagtctttaactccgtatactgcaataaatgatactgccatgttatggggtgttaaatttttcaacgatttgctttcccaagctggtcagctcggtaatgtgcagtcagagctacttttccgaaaggacaaagcaactttcacttttgagaagggttgggctttcgctcgaagaatctacttcaatggagataattgtgttatgccaccgcccgacgcctatccttggttgcctaacggcagttcccatcagcttatctccacacttagtttgttgacaactctcttggcagcaatggcatttttattgggatatgcataaagttcaaccatttttatactgggaaatctggtatgctccaaaattttgactgaatcagttcgatgtagaatgtacggcgtgagaagttgcagtttgtgtcagttagaggaagtcaatgtgcagtggtgtcgttttaatgtatggtcagtgaattcactcgtgctgttgtatgtatgcatgttcgtttatgtacttaaaccaaaaacaatgttgattgtagaattcccacgatattttattacagtagtaacagacataaatcattgac

SEQ ID NO: 158 - protein, 455 aa, Gossypium hirsutum
  misc_feature (60)..(224): Pfam Name: Phytochel_synth Pfam Description: Phytochelatin synthetase-like
  misc_feature: Ceres Clone ID no. 1883580
  misc_feature: Bit score of 955.3 for HMM based on sequences of Figure 3
  misc_feature: Functional Homolog Of SEQ ID NO. 117
MSNLFLFIARSFFNLSSFSVLLLFLLSFSSFTATEAYDPLDPNGNITIKWDIMSWTADGYVAVVTIFNFQQYRHIQAPGWTLGWKWSKKEVIWSMMGGQTTEQGDCSRFKGNIPHCCKKDPTVVDLLPGTPYNQQIANCCKGGVLNSWVQDPATAASSFQVSVGQAGTTNKTVRVPKNFTLKAPGPGYTCGPAKIVKPSRFVTADKRRVTQALMTWNVTCTYSQFLAQKTPTCCVSLSSFYNETIVPCPQCACGCQNTSQPGSCVDPKAPHIASVVPSTGKNNYAPLVQCTSHMCPVRVHWHVKLNYKEYWRVKVTITNFNYNMNYTQWNLVVQHPNFDNLTQIFSFNYKSLTPYTAINDTAMLWGVKFFNDLLSQAGQLGNVQSELLFRKDKATFTFEKGWAFARRIYFNGDNCVMPPPDAYPWLPNGSSHQLISTLSLLTTLLAAMAFLLGYA

SEQ ID NO: 159 - DNA, 1877 bp, Gossypium hirsutum
  misc_feature: Ceres Clone ID no. 1848658
  misc_feature: Encodes the peptide sequence at SEQ ID NO. 160
aataaccgacagcttgcacccatatggatggagcatgtacctctctgtctcagactctgtactaaattgcttttataagcttcacttgcaactcaacagctgacctctctcttctccatttgatgtgagaaggatctttctttctttattctgcacatcttaaccttaaccacatcataagatagagatctcttaaacgatcgagttatggagactgtcttttcagcagcaagtagatccatttccaagctcattagcttcaccgctttgcttcttttcttgttttcctgctctactttcacttctactgaagcttatgatgcgcttgatccaactggcaatatcactatcaaatgggacgtaataagttggaccccagatggctatgttgctgttgttacaatgtacaatttccaacagtatcgccatattcaggcacctggttggacattggggtggacatgggccaaaaaggaagtaatctggagcatgatgggaagccaaaccacggaacaaggggattgttcaaaatacaaaggaaacgtccctcattgctgtaaaaaggatcccacagttgtggatttattgcctggaactccttataaccagcagattgcaaattgctgcaaaggcggtgtattaaattcatgggttcaagacccagccaatgcagcaagctcatttcaggttagtgtgggcgctgcaggaacaacgaacaaaactgtgagagtgcctagaaactttaccctgaaagcaccaggtccaggatatacttgtgggcctgccaagattgtgaaacccactaaattcataacggctgataaaaggagaataactcaagctatgatgacatggaatgttacatgcacatattcccaatttctggctcaaaagactcctacatgttgcgtctcgctctcttccttctataataacactatcgtgaattgcccgacatgtgcttgtggctgtcagaataactcaactgaatctgggagttgtgtaagcgaaaggtcttcacatttagcttcagctgttccgggcaaatctaccaatgcaccacctctgcttcagtgtacgagccatatgtgtccagttcgaattcactggcatgttaagctcaactacaaggaatactggcgtgtgaagatcacaatcaccaatttcaattacgcattgaactacagtcagtggaatctagttgtgcaacaccccaactttgacaatcttacacaacttttcagcttcaattacaaaccattaactccttatgctggcttaaatgatactgccatgttatggggacttaagttttataatgatttcctcaacgaagccggtcctcttgggaatgtgcagtcagaactattattcagaaaagatgcatcaacttttacttttgaaaagggatgggcttttccacggagaatatatttcaatggtgataactgtgtcatgccacctcccgatgcctacccttggttgccgaatactggtttgaagccagttatctctctgtttcagccagtcatgacgatcttggcatcatgtgttttcttatgggctaatatgtgatgaatgctgtctgcggaaaccgctaaaactatttgttcgacatcctgcaatttgcatctggtttcatattatcacactgaagcttttggtgatcgattcaatggtgttggaatagtttggtgcggcaatgtaacacgctaaagagtggatcaaggtgcacaatctctggtccctatagcatgtggtgtattatttatatgttggggtttgtaatttacaccatttccttttggagttaactgctttgttgtatgtttcattcacatcatacacatgatcgatttatttgtagaatatccttg

SEQ ID NO: 160 - protein, 455 aa, Gossypium hirsutum
  misc_feature (60)..(224): Pfam Name: Phytochel_synth Pfam Description: Phytochelatin synthetase-like
  misc_feature: Ceres Clone ID no. 1848658
  misc_feature: Bit score of 946.6 for HMM based on sequences of Figure 3
  misc_feature: Functional Homolog Of SEQ ID NO. 117
METVFSAASRSISKLISFTALLLFLFSCSTFTSTEAYDALDPTGNITIKWDVISWTPDGYVAVVTMYNFQQYRHIQAPGWTLGWTWAKKEVIWSMMGSQTTEQGDCSKYKGNVPHCCKKDPTVVDLLPGTPYNQQIANCCKGGVLNSWVQDPANAASSFQVSVGAAGTTNKTVRVPRNFTLKAPGPGYTCGPAKIVKPTKFITADKRRITQAMMTWNVTCTYSQFLAQKTPTCCVSLSSFYNNTIVNCPTCACGCQNNSTESGSCVSERSSHLASAVPGKSTNAPPLLQCTSHMCPVRIHWHVKLNYKEYWRVKITITNFNYALNYSQWNLVVQHPNFDNLTQLFSFNYKPLTPYAGLNDTAMLWGLKFYNDFLNEAGPLGNVQSELLFRKDASTFTFEKGWAFPRRIYFNGDNCVMPPPDAYPWLPNTGLKPVISLFQPVMTILASCVFLWANM

SEQ ID NO: 161 - DNA, 1362 bp, Populus balsamifera subsp. trichocarpa
  misc_feature: Ceres Annot ID no. 1450185
  misc_feature: Encodes the peptide sequence at SEQ ID NO. 162
atgggctttcttgtctctcccatgatgagtttgttctcaaaattcactgtcctgctgctttttgtgctttggtgcgctagttttacttcaacagaagcctatgatcctcttgaccctactgggaatattacaatcaaatgggacatcataagctggactgctgatggctatgtcgctgttgtcacgatttacaacttccagcagtatcgtcacattcaagcaccaggatggtcactgggatggacatgggcaaagaaggaggtaatatggagcatgctgggaggccaagcaaccgaccaaggagattgttcaaaattcaaaggaaacgttccacattgttgtaaaaagagtccgacggttgtagatttattgccaggaactccttataaccagcagactgcaaattgctgcaaggggggagttatcagctcatgggcgcaagatccagccaatgcagcaagctccttccagcttagcgtgggttcagctggaaccagtaacaaaacagtgagattaccaaaaaacttcactctgaaggcaccaggacctggttatacttgtgctcgtgcaaaaattgttaagcctactagatttatgtctacagataaaaggagaatcactcaagctttgatgacatggaacgttacttgcacatattcacaattcctggctcagaagactcctagttgctgtgtctccctctcatcattctacaacgacactatagttccttgtccaaaatgcacctgtggctgccaaagaaacaattcggattcggggggttgtgttgatccaaatgcaccacatttagcttcggttgtttcgagtctagggaataacaaccctatgcctcttgtccaatgcacaagtcacatgtgcccgatcagagttcactggcatgttaagcttaactacaagcaatactggcgcgttaaggtcacaattacaaatttcaattataacatgaactatacgcaatggaacttagttgtgcaacaccccaactttgacaatctgacccagagtttcagttttaactaccagtcattatctccttattcagctattaatgatactgccatgttgtggggagtaaagttctacaatgacttgcttatgcaagccggtcgttctggtaatgttcagtcagagctactttttcgaaaggacaagtcaacttttacctttgataaaggctgggccttccctcggagaatctatttcaatggtgacaattgcgttatgcctcctccagatgcgtatccatggttgcctaatgcaagttcacgccagcttacttcaccgcttatgctaatgatagccttcttttctgttttggctttcttatatggatacgcgtag

SEQ ID NO: 162 - protein, 453 aa, Populus balsamifera subsp. trichocarpa
  misc_feature (57)..(221): Pfam Name: Phytochel_synth Pfam Description: Phytochelatin synthetase-like
  misc_feature: Ceres Annot ID no. 1450185
  misc_feature: Bit score of 940.5 for HMM based on sequences of Figure 3
  misc_feature: Functional Homolog Of SEQ ID NO. 117
MGFLVSPMMSLFSKFTVLLLFVLWCASFTSTEAYDPLDPTGNITIKWDIISWTADGYVAVVTIYNFQQYRHIQAPGWSLGWTWAKKEVIWSMLGGQATDQGDCSKFKGNVPHCCKKSPTVVDLLPGTPYNQQTANCCKGGVISSWAQDPANAASSFQLSVGSAGTSNKTVRLPKNFTLKAPGPGYTCARAKIVKPTRFMSTDKRRITQALMTWNVTCTYSQFLAQKTPSCCVSLSSFYNDTIVPCPKCTCGCQRNNSDSGGCVDPNAPHLASVVSSLGNNNPMPLVQCTSHMCPIRVHWHVKLNYKQYWRVKVTITNFNYNMNYTQWNLVVQHPNFDNLTQSFSFNYQSLSPYSAINDTAMLWGVKFYNDLLMQAGRSGNVQSELLFRKDKSTFTFDKGWAFPRRIYFNGDNCVMPPPDAYPWLPNASSRQLTSPLMLMIAFFSVLAFLYGYA

SEQ ID NO: 163 - protein, 442 aa, Arabidopsis thaliana
  misc_feature (50)..(214): Pfam Name: Phytochel_synth Pfam Description: Phytochelatin synthetase-like
  misc_feature: Public GI ID no. 13477083
  misc_feature: Bit score of 931.3 for HMM based on sequences of Figure 3
  misc_feature: Functional Homolog Of SEQ ID NO. 117
MNILFSRFSFLLLFLCSWTNLSNTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDCDSPKIASVVPALGKNNLEPLLQCTQHMCPIRVHWHVKTSYKEYWRVKVAITNFNYNMNYSQWNLVVQHPNFDNLTKLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 164 - protein, 457 aa, Oryza sativa subsp. japonica
  misc_feature (60)..(224): Pfam Name: Phytochel_synth Pfam Description: Phytochelatin synthetase-like
  misc_feature: Public GI ID no. 115463639
  misc_feature: Bit score of 955.6 for HMM based on sequences of Figure 3
  misc_feature: Functional Homolog Of SEQ ID NO. 117
MAVGGAGSSRSVAPCCCCAVLLAAALLFSAPATTEAYDALDPNGNITIKWDVMSWTPDGYVAVVTMFNYQQFRHIQAPGWQLGWTWAKKEVIWSMVGAQTTEQGDCSKFKGGTPHCCKKDPTVVDLLPGTPYNMQIANCCKAGVINTFNQDPSNAASSFQISVGLAGTTNKTVKLPKNFTLKAPGPGYTCGRAMIVRPTKFFTGDGRRATQALMTWNVTCTYSQFLAQKTPSCCVSLSSFYNDTIVNCPTCSCGCQNNGTSPGSCVNENSPYLQSAIDGPGKWTGQPLVQCTSHMCPIRIHWHVKLNYKEYWRVKITITNFNYRMNYTQWNLVAQHPNFNNITQLFSFNYKPLTPYGSKINDTAMFWGVKFYNDLLMQAGPLGNAQSELLLRKDSKDFTFDKGWAFPHRVYFNGDNCVMPPPDAYPWLPNASPLTKQPLTLSVLVFSIVLATLLAYA

SEQ ID NO: 165 - DNA, 1503 bp, Arabidopsis thaliana
  misc_feature: Ceres Clone ID no. 98007
  misc_feature: Encodes the peptide sequence at SEQ ID NO. 166
cttctctttcctctctctcacacacatcttcgagaagtttccgccggcgggagagatcaaagacaactgctgatcagaaatcagagatcagagatatgaacattctcttctccagattctcctttttgcttctgtttctctgttcttggaccattttcactttcaccacaacagaagcttatgatgcacttgatccatatggaaacattactataaaatgggatattatgagctggactggtgatggttatgtggctgttgtaacaatctttaatttccaacaataccgtcacatagaggcgccggggtggcaattaggatggagttggatgaagaaggaagtaatatggagtatggttggtggtcaagcaacagaacaaggagattgttctaagtttaagggtaacattcctcattgctgcaagaaaactccggctatcgttgatttgttaccgggaactccttataaccagcagatatccaactgttgtagagggggtgtgattagcgcgtgggcacaagaccccgcaaccgcgatttcttcgtttcagatcagtgttggccagtctggaacaactaatactacggttagagcacctaggaatataactttgaaggctccaggacctggttacacttgcgggcctgcaaaactcgttaagccgagtagattcatttccgcggataaacgaagaaagactcagtctttgcttacatggaacattacttgcacatattcgcagtttctagcacggaaaactccgacttgttgtgtctcactctcagccttctacaatgaaactatagtaccatgtccaacttgttcttgtggatgtcaaaatagttctcaagctggtacatgtgttgaccctaaaatagcttcagtagtaccagccttagggaagaacaacctcgaacctctcttgcaatgtacgcaacatatgtgtcccattcgagttcattggcatgtaaaaactagctacaaagagtactggagagtgaaggttgccatcacaaactttaactacaatatgaactactctcagtggaacttagtctttcagcatcccaacttcgacaatctcactcagcttttcagtttcaactacaaaccgcttaatccttacttgaacataaatgacacggccatgctatggggaatcaagttctacaatgattttttaagccaagctggtccagtaggcaatgtacagtcagagcttctcttccaaaagaacccattggagttcacattcgagaaaggatgggcgtttccgaggcgcatatacttcaacggtgataactgcgttatgccacctccagactcttatccatggcttccaaacgctagtccaaacattgcaacctcgccatttgtcatacttctcatcactttcttatctgttttgattcttatgtaaatggatatctatataccgtcatggacatgtttggtgatgtttacattataagtgagtgtgttattaggaaatcattctttgc

SEQ ID NO: 166 - protein, 441 aa, Arabidopsis thaliana
  misc_feature (52)..(216): Pfam Name: Phytochel_synth Pfam Description: Phytochelatin synthetase-like
  misc_feature: Ceres Clone ID no. 98007
  misc_feature: Bit score of 914.3 for HMM based on sequences of Figure 3
  misc_feature: Functional Homolog Of SEQ ID NO. 117
MNILFSRFSFLLLFLCSWTIFTFTTTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDPKIASVVPALGKNNLEPLLQCTQHMCPIRVHWHVKTSYKEYWRVKVAITNFNYNMNYSQWNLVFQHPNFDNLTQLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 167 - DNA, 1326 bp, Arabidopsis thaliana
  misc_feature: Ceres Annot ID no. 1326475
  misc_feature: Encodes the peptide sequence at SEQ ID NO. 168
atgaacattctcttctccagattctcctttttgcttctgtttctctgttcttggaccagtttcactttcaccacaacagaagcttatgatgcacttgatccatatggaaacattactataaaatgggatattatgagctggactggtgatggttatgtggctgttgtaacaatctttaatttccaacaataccgtcacattgaggcgccggggtggcaattaggatggagttggatgaagaaggaagtaatttggagtatggttggtggtcaagcaacagaacaaggagattgttctaagtttaagggtaacattcctcattgctgcaagaaaactccggctatcgttgatttgttaccgggaactccttataaccaacagatatcaaactgttgtagaggcggtgtgattagcgcgtgggcgcaagaccccgcaaccgcgatttcttcgtttcagattagtgttggccagtctggaacaactaatactacggttagagcacctaggaatataactttgaaggctccaggacctggttacacttgcgggcctgcaaaactcgttaagccgagtagattcatttccgcggataaacgaagaaagactcagtctttgcttacatggaacattacttgcacatattcgcagtttctagcacggaaaactccgacttgttgtgtctcactctcagccttctacaatgaaactatagtaccatgtccaacttgttcttgtggatgtcaaaatagttctcaagctggtacatgtgttgaccctaaaatagcttcagtagtaccagccttagggaagaacaacctcgaacctctcttgcaatgtacgcaacatatgtgtcccattcgagttcattggcatgtaaaaactagctacaaagagtactggagagtgaaggttgccatcacaaactttaactacaatatgaactactctcagtggaacttagtcgttcagcatcccaacttcgacaatctcactaagcttttcagtttcaactacaaaccgcttaatccttacttgaacataaatgacacggccatgctatggggaatcaagttctacaatgattttttaagccaagctggtccagtaggcaatgtacagtcagagcttctcttccaaaagaacccattggagttcacattcgagaaaggatgggcgtttccgaggcgcatatacttcaacggtgataactgcgttatgccacctccagactcttatccatggcttccaaacgctagtccaaacattgcaacctcgccatttgtcatacttctcatcactttcttatctgttttgattcttatgtaa

SEQ ID NO: 168 - protein, 441 aa, Arabidopsis thaliana
  misc_feature (52)..(216): Pfam Name: Phytochel_synth Pfam Description: Phytochelatin synthetase-like
  misc_feature: Ceres Annot ID no. 1326475
  misc_feature: Bit score of 916.0 for HMM based on sequences of Figure 3
  misc_feature: Functional Homolog Of SEQ ID NO. 117
MNILFSRFSFLLLFLCSWTSFTFTTTEAYDALDPYGNITIKWDIMSWTGDGYVAVVTIFNFQQYRHIEAPGWQLGWSWMKKEVIWSMVGGQATEQGDCSKFKGNIPHCCKKTPAIVDLLPGTPYNQQISNCCRGGVISAWAQDPATAISSFQISVGQSGTTNTTVRAPRNITLKAPGPGYTCGPAKLVKPSRFISADKRRKTQSLLTWNITCTYSQFLARKTPTCCVSLSAFYNETIVPCPTCSCGCQNSSQAGTCVDPKIASVVPALGKNNLEPLLQCTQHMCPIRVHWHVKTSYKEYWRVKVAITNFNYNMNYSQWNLVVQHPNFDNLTKLFSFNYKPLNPYLNINDTAMLWGIKFYNDFLSQAGPVGNVQSELLFQKNPLEFTFEKGWAFPRRIYFNGDNCVMPPPDSYPWLPNASPNIATSPFVILLITFLSVLILM

SEQ ID NO: 169 - protein, 473 aa, Oryza sativa subsp. japonica
  misc_feature (45)..(231): Pfam Name: Phytochel_synth Pfam Description: Phytochelatin synthetase-like
  misc_feature: Public GI ID no. 115473243
  misc_feature: Bit score of 971.0 for HMM based on sequences of Figure 3
  misc_feature: Functional Homolog Of SEQ ID NO. 117
MAVLGSLLLLILAATLSVAVAYDPLDPNGNITIKWDVMSWTPDGYVAMVTINNYQTYRQIMAPGWTVGWTWARQEVIWSMVGAQATDQGDCSRFKANLPHCCRRTPAVVDLLPGVPYNQQIANCCRGGVLPAYGQAPSAAAAAFQVSVGQAGTTNRTVRLPRNFTLLGPGPGYTCGRARVVPSTVFLTADRRRKTQALSKLTTPSSSSPAPPLMMSCLCAVTWNVTCTYSQHLASKYPSCCVSFSSFYNDTIVPCAKCACGCDAHKPCVRSERDGKRLAVTGKKHDANANAHGRGNGVAAAAMAAPLLQCTTHMCPVRVHWHVKLNYREYWRAKITIVNFNYRMNYTGWTLVAQHPNLDNITEVFSFDYKPVVSYGSINDTAMFYGLKYFNDQLMEAGPHGNVQSEVLMRKDARTFTFRQGWAFPRKVYFNGDECQMPPPDSYPYLPNAAPPAAASLVGSAVAMAALVFFLMA

SEQ ID NO: 170 - DNA, 1575 bp, Arabidopsis thaliana
  misc_feature: Ceres Annot ID no. 870466
  misc_feature: Encodes the peptide sequence at SEQ ID NO. 171
acttgtcagagacagaagattaaagaagaagaggcgtttctctctctttttttgcttcagaaaaaatggggtttttcttgtgttcctcttcttcaatcttcttcaagttcggaatctctataatctttctagtttctttctctggtttaactccttcagaagcttatgatcctttggacccgagtgggaacattactgtcaaatgggatatcataacctggactggagatggctatgtggcgactgtaacggtatataattttcagcaatatcgacacattcaagctccaggttggactcttggatggtcatgggcaaagagagaggttatatggggaatgaatggaggacaaaccacagaacaaggagattgttctaaattcaaaggaaccattcctcattgctgtaaaaagacaccttctgttgttgatctcttacctggatctccttacaatcagcagattgctaattgttgcagagggggtgtgcttaactcgtgggctcaagatcccgcaactgctgtttccgctttccagcttactgttggacaagctggaaccacaaataagacagttagggtacctaagaatttcactctcaaagctcctggaccgggatatacttgtagccccgcgaagattgtaaaaccgactagattcatcggtactgataaacgaagagttactcaagcattaatgacttggaatgtaacttgcacatactcgcagttcttagctcagaaaacaccaacttgctgtgtatctctttcatcgttttataacaagacaatagtttcttgtccaacatgctcttgtggatgcagaaacacttctcagccagggaattgtgtagacccaaaaggtccacggatagcatcagtcattccaaatccggggaagaacgcatatataccgcctctggtccaatgtacaaagcatatgtgtccagttagaatccactggcatgtgaaagtcaactacaaacagtactggagagttaaagtcaccatcacaaatttcaactacaacatgaactattcacagtggaatctcgtcgtgcagcatccgaatttcgacaatctaactcagacttttagcttcaactataaacctctgactccttatgcttccataaatgatactgggattctctggggaataaagttctacaatgatctgttgatgcaagctgggccatttggtaatgtacaatctgagctacttttccagaaagaagcatcagctttcacatttgagaaaggttgggcgtttccaagaagaatctatttcaatggagataactgtgtgatgcctcctcctgattcttacccttggctgcccaataccggctcgcacaaatcagtcggttccctgtttgcagcaatggccttgttactgattgtgttcctacatggaaacttgtaagaatcatcaagtgtagaattcttctgctgcagtttttcgaactgatataacccatcaagagagagttggtagcttagttttttgtgttctctcttgtctgtcctcttcctgtacaacgctttaatattagatggttaactagatccccttg

SEQ ID NO: 171 - protein, 452 aa, Arabidopsis thaliana
  misc_feature (57)..(221): Pfam Name: Phytochel_synth Pfam Description: Phytochelatin synthetase-like
  misc_feature: Ceres Annot ID no. 870466
  misc_feature: Bit score of 929.7 for HMM based on sequences of Figure 3
  misc_feature: Functional Homolog Of SEQ ID NO. 117
MGFFLCSSSSIFFKFGISIIFLVSFSGLTPSEAYDPLDPSGNITVKWDIITWTGDGYVATVTVYNFQQYRHIQAPGWTLGWSWAKREVIWGMNGGQTTEQGDCSKFKGTIPHCCKKTPSVVDLLPGSPYNQQIANCCRGGVLNSWAQDPATAVSAFQLTVGQAGTTNKTVRVPKNFTLKAPGPGYTCSPAKIVKPTRFIGTDKRRVTQALMTWNVTCTYSQFLAQKTPTCCVSLSSFYNKTIVSCPTCSCGCRNTSQPGNCVDPKGPRIASVIPNPGKNAYIPPLVQCTKHMCPVRIHWHVKVNYKQYWRVKVTITNFNYNMNYSQWNLVVQHPNFDNLTQTFSFNYKPLTPYASINDTGILWGIKFYNDLLMQAGPFGNVQSELLFQKEASAFTFEKGWAFPRRIYFNGDNCVMPPPDSYPWLPNTGSHKSVGSLFAAMALLLIVFLHGNL

SEQ ID NO: 172 - DNA, 1823 bp, Panicum virgatum
  misc_feature: Ceres Clone ID no. 1806851
  misc_feature: Encodes the peptide sequence at SEQ ID NO. 173
ctcgcacccacaagaatagctcaaacccgcgtgcatgtctgcatccccgggcggacacggcgcgcgccagaagcctcgcatcgccatcgcgcatacaaactggcaggccagacaccacaggacgagagacagagaggaaacctctgcttctccctctgacccactcctcgttcttctgagctcctgttgccttcctccgcacggagagcagacacgccgagagcgatcagggcagggaggggtctgctgcttacttcctgagctctgccgggccgggccatggcgggacggcggacggcgcccctgcgcctgtgcgcctccgtcgcgctgctcgtcgtcgccgtctcctctctgacgccttcgtcagatgcatacgatccactcgatccgaatgggaacataacaatcaagtgggatgtaatgcagtggactccagatggctatgtggctgttgtttccctatacaattaccagcagtaccgccacatccaagcgccgggctggaaactcggatgggtttgggcaaagaaggagataatctgggcaatgaccggtggccaagccactgagcaaggcgattgctccaaattcaaaagcaacattccccattgctgcaagaaggatcctgaggttgtggacctgcttcctggcacaccttataacatgcagatcgccaactgctgcaagggaggagtcctcaccgcatgggcacaggaccctgacaatgctgtggcttcgttccaagtcagtgttggtcaggctgggacgaccaacaagactgtgaaggtgcccaagaatttcactctgaaggctcccgggccagggtatacctgcggccctgccaaactagtgaaacctactaagttcatatcgccggatgggagaagatcaactcaagcacacatgacttggaatgtgacctgtacatactcacagtttgttgcccaaagatctccaacctgctgtgtttcgctttcatcgttttacaacgacaccattgtcaactgcccaacatgctcttgtggatgccagaataacagcactgcaccaggaagctgtgtagagggtaattcaccttatctggcctctgtcgtgaacgatcctaacaagaacagcttggcacctctagtccaatgcacttctcacatgtgcccaataagagtgcattggcatgtcaaagtgaactacaaggagtactggagggtcaagatcaccgtgacaaacttcaactaccggatgaactactcgcagtggaacctcgttgcgcagcaccccaacttcgacaacctgactaccattttcagcttcaactacaaatctctgaacccctatggcgtaataaacgacaccgcgatgttatggggcatcaagtactacaacgatctgctgatgacggctgggccggacgggaatgttcagtctgagcttctgttccggaaggagccctccaccttcaccttccagaaaggctgggctttcccaagacgagtgtacttcaatggcgacaactgcgtgatgccgccgccggacgcgtacccatggctgcccaacgcctctccacggcagtcagcttcggttctcctcacatttgttgctgtttgggcagcattggcgatcctactggccaatccctagtgatgtagtacatgtttcacagaaagttttgacctgattgcattggatgctattgccttctgatcattgagtttcttgcgatggtgttcaaatgtacagttacgtactcaaggatgtacattcccgtacttgtaaattttagcaaagactgactggcgagaaataaagctgtttcctcggcatcatgc

SEQ ID NO: 173 - protein, 451 aa, Panicum virgatum
  misc_feature (55)..(219): Pfam Name: Phytochel_synth Pfam Description: Phytochelatin synthetase-like
  misc_feature: Ceres Clone ID no. 1806851
  misc_feature: Bit score of 944.6 for HMM based on sequences of Figure 3
  misc_feature: Functional Homolog Of SEQ ID NO. 117
MAGRRTAPLRLCASVALLVVAVSSLTPSSDAYDPLDPNGNITIKWDVMQWTPDGYVAVVSLYNYQQYRHIQAPGWKLGWVWAKKEIIWAMTGGQATEQGDCSKFKSNIPHCCKKDPEVVDLLPGTPYNMQIANCCKGGVLTAWAQDPDNAVASFQVSVGQAGTTNKTVKVPKNFTLKAPGPGYTCGPAKLVKPTKFISPDGRRSTQAHMTWNVTCTYSQFVAQRSPTCCVSLSSFYNDTIVNCPTCSCGCQNNSTAPGSCVEGNSPYLASVVNDPNKNSLAPLVQCTSHMCPIRVHWHVKVNYKEYWRVKITVTNFNYRMNYSQWNLVAQHPNFDNLTTIFSFNYKSLNPYGVINDTAMLWGIKYYNDLLMTAGPDGNVQSELLFRKEPSTFTFQKGWAFPRRVYFNGDNCVMPPPDAYPWLPNASPRQSASVLLTFVAVWAALAILLANP

SEQ ID NO: 174 - protein, 446 aa, Oryza sativa subsp. japonica
  misc_feature (52)..(216): Pfam Name: Phytochel_synth Pfam Description: Phytochelatin synthetase-like
  misc_feature: Public GI ID no. 75133695
  misc_feature: Bit score of 926.5 for HMM based on sequences of Figure 3
  misc_feature: Functional Homolog Of SEQ ID NO. 117
MALLLLRMGVSVALLVAFFSSLIPSSEAYDPLDPNGNITIKWDVLQWTPDGYVAVVSLYNYQQYRHIQSPGWKLGWVWAKKEIIWAMNGGQATEQGDCSKFKSNIPHCCKKDPEIVDLLPGTPYNMQIANCCKGGVLNSWAQDPANAIASFQVSVGQAGTTNKTVRVPRNFTLKSPGPGYTCGSAKVVRPTKFFSQDGRRTTQAHMTWNVTCTYSQIVAQRSPTCCVSLSSFYNDTIVNCPTCSCGCQNNKPGSCVEGNSPYLASVVNTHNKDSLTPLVQCTSHMCPIRVHWHVKVNYKEYWRVKITVTNFNYRMNYSQWNLVTQHPSFDNLTTIFSFNYKSLNPYGVINDTAMLWGIKYYNDLLMTAGPDGNVQSELLFKKDPKSFTFEKGWAFPRRVYFNGDNCVMPPPDAYPWLPNASTRVMSSILLPFITIWTALTFLMVYA

SEQ ID NO: 175 - DNA, 1948 bp, Panicum virgatum
  misc_feature: Ceres Clone ID no. 1788775
  misc_feature: Encodes the peptide sequence at SEQ ID NO. 176
aagggagcagccgctgcggagcagagtgtcgcgctgccgccgcggtaaaaacaggggaggagggagagacgcggccgcacccgcacatgctttaagtcccactccccaccgccccagatctccgccctcctccctctgccccccacattccccggcgcgccacctctgcccgcggccgccgccgctgtccggagcgagatcggcgtgggtgcacgggcgcagctcctgtatctgtcggtgggagaccccgcgcgtgtcggtgggagcgggtggggaggaagcgaaggatggcggcgggcggcagatccgtcgcgtgctgcaccgccgtgctgctcgcggccgcgctgctcctctccgcgccgactgccacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactaccgaacagggtgactgctcgaaattcaagggcaacactccccactgctgcaagaaagatcccacgatcgtcgatttacttccgggcactccatacaacatgcaaattgccaattgctgcaaagcaggagttataaatacatttaatcaggacccagcaaatgctgcttcctccttccagattagtgtaggtcttgctgggactaccaataagactgttaaggtgccgaagaacttcactcttaagactccaggtcctgggtacacctgtgggcgtgccattgttggcaggccgacaaagtttttcacctcggatggacgcagggcaacccaagctctaatgacgtggaatgtgacttgcacatattcccaatttctagcccagaagactccgtcctgctgtgtatctctctcatcattttacaatgacacaattgtgaactgcccaacatgctcttgtggctgccaaaatccaagtggctccaactgtgtgaatgaggattcaccgaatctacaatctgcaattgatggccctgggaaatggactggtcagcctcttgtacaatgcacctcccacatgtgcccgataagaatccactggcatgtgaagctcaattacaaggaatactggagagtgaaaatcactatcacaaacttcaacttccgcatgaattacacgcagtggaacttagtcgttcagcatccaaactttgataatatcactcagctgttcagtttcaactacaaaccacttaccccatatggtggtggcataaatgatacggcaatgttctggggtgtaaaattctacaacgatttgctgatgcaagctggtaaacttgggaatgtgcaatcagaactacttcttcgcaaggactcccaggctttcaccttcgaaaagggatgggccttcccacgccgagtgtacttcaatggtgataactgtgtcatgccatctcctgaaaattatccatggctgcccaatgcaagccctctaacaaaacaaccattgacactcccactcttagtattctgggttgtgttggctactctgttggcttatgcgtgatgagtgggatcaagagatttagcgagcttcaagttgatgtcagattccatgaggtgcactgcagcaggccatttgttcattcacttccatggttgcacagaagagatgacaccacgccgagaaaagaaagtttatatgtgtgtgtgtttttggaagttaaggcccaaaatgtatttcttgtctggtatatactggccccacagcactttggtgaacttagttactgcaaattaggtaattacagttgcaccttttgtattttatagcaaactcagaatttttcattgaattatgactgctcttcttgtagc

SEQ ID NO: 176 - protein, 449 aa, Panicum virgatum
  misc_feature (54)..(218): Pfam Name: Phytochel_synth Pfam Description: Phytochelatin synthetase-like
  misc_feature: Ceres Clone ID no. 1788775
  misc_feature: Bit score of 935.6 for HMM based on sequences of Figure 3
  misc_feature: Functional Homolog Of SEQ ID NO. 117
MAAGGRSVACCTAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPSGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLLVFWVVLATLLAYA

SEQ ID NO: 177 - DNA, 1849 bp, Zea mays
  misc_feature: Ceres Clone ID no. 1546455
  misc_feature: Encodes the peptide sequence at SEQ ID NO. 178
gccctcctcaccactgcccccccattccccggcgcccagcacccggcgccgcaaccgccgcagtccggagcaagatcggtgggtagacggacgggcgacaggcgggcgggcgcggctctgtctgtatctatctgttggtgggagaccggttgtgtcggttaggcggcggcgggtgggaaggaagaatggcggcgggcggcagatccatcgcgtgcgttgccgccgtgctgctcgcggccgcgctgctcctctccgcaccgaccaccacagaggcctacgattcgctggatccaaacggcaacatcactataaaatgggatatcatgcagtggactcctgacggatatgtcgctgttgtcacaatgttcaattatcaacaatttcggcacatcggggcacctggatggcagcttgggtggacatgggcaaaaaaggaggttatatggtcaatggttggggctcagaccactgaacagggtgactgctcaaagttcaagggcaacaccccccattgctgcaagaaagatccaacaattgttgatttacttccaggcactccatacaacatgcaaattgccaattgctgcaaggcaggagttataaatacctttaaccaggacccagcaaatgctgcttcctccttccagatcagtgttggtcttgctggaactaccaataaaactgttaaggtgccgaagaatttcactcttaagactccaggccctgggtacacatgtgggcgtgctattgttggcaggccaacgaagtttttctctgcagatgggcgcagggtaacccaagctctaatgacatggaatgtgacctgcacatattcccaatttcttgctcagaagactccatcctgctgtgtatctctctcatcattttataatgacacaattgtgaactgcccgacatgctcatgtggctgccagaacccaagtgggtcaaactgtgtgaacgaggattcacctaatctacaagccgcaattgatggtcctggtaaatggactggccagcctcttgtacaatgcacttctcacatgtgcccaataagaatccactggcatgtgaagctcaactacaaggaatactggagagtgaaaatcactatcacgaacttcaacttccgcatgaattacacacagtggaacttagttgctcagcatccaaactttgataatatcactcagttgttcagcttcaactacaaaccacttactccatatgggggtggcataaatgatacggcaatgttctggggtgtaaagttctacaatgatttgctgatgcaagccggcaaacttgggaatgtgcaatcagaactgcttctccgcaaggactcacggactttcacattcgaaaagggatgggccttcccacgccgagtgtacttcaatggtgataattgtgtcatgccatctcctgaaaattatccatggctgccgaatgcaagccctctaacaaaacaagcattgacactcccactcttgatattctgggttgccttggctgttctgttggcttatgcatgatgagtgggatcaagatgtttagcaagcttcaagttgatgtcggattccatgaggtgcactgcaacgggatatttattcattcaattccatagcggcacaggagagatgaggcgaagccaagaaaaagtggatgtgtgtgtgtgtgtgtttgtaagttaaagggccaaaatgtatttcttgtctggtagtatatagcagctctacaacactttggtgaacttagttactgcaaattaggcaattacagttgcaccttttgtattttatagcaaacccagacttctattggattctatgactgcccctcttgtagc

SEQ ID NO: 178 - protein, 449 aa, Zea mays
  misc_feature (54)..(218): Pfam Name: Phytochel_synth Pfam Description: Phytochelatin synthetase-like
  misc_feature: Ceres Clone ID no. 1546455
  misc_feature: Bit score of 936.8 for HMM based on sequences of Figure 3
  misc_feature: Functional Homolog Of SEQ ID NO. 117
MAAGGRSIACVAAVLLAAALLLSAPTTTEAYDSLDPNGNITIKWDIMQWTPDGYVAVVTMFNYQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFFSADGRRVTQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKQALTLPLLIFWVALAVLLAYA

SEQ ID NO: 179 - DNA, 1771 bp, Panicum virgatum
  misc_feature: Ceres Clone ID no. 1902642
  misc_feature: Encodes the peptide sequence at SEQ ID NO. 180
agggagcagccgctgcggagcagagtgtgtcgcgctgccgccgcggtaaaaaacaggggagggcgaggcgcggccgcacatgctttaagtcccactccccaccgccccagatctccgcccccctcccactccggcactcccccccacattccccggcgcgccacctctgcccgcggccgccgccgccgccgtccggagcgagatcggcgtgggtgcacgggcgcggctcctgtatctgtcggtgggagaccccgcgtgtcggtgggagcgggtggggaccaagcgaaggatggcgccgggcggcagatccgtcgcgtgctgcgccgccgtgctgctcgcggccgcgctgctcctctccgcgccgactgctacagaggcttatgattccttggatccgaacggcaacatcactataaaatgggatattatgcagtggactcctgatggatatgtcgctgttgtcacaatgttcaactatcaacaattccggcacattggggcacctgggtggcagcttgggtggacatgggcaaagaaagaggtcatatggtcaatggttggggcacagactactgagcagggtgactgctcgaaattcaaaggcaacactccccactgctgcaagaaagatcccacgctcgtcgatttacttccgggcactccgtacaacatgcaaattgccaattgctgcaaagcaggagttataaatacatttaatcaggacccagcaaatgctgcttcctccttccagattagtgtaggtcttgctgggaccaccaataagactgttaaggtgccgaagaacttcactcttaagactccaggtcctgggtacacatgtgggcgtgccattgttggcaggccgacaaagtttttcacatcagatggacgcagggcaacccaagctctaatgacatggaatgtgacttgcacatattcccaatttctagcccagaagactccgtcctgctgtgtatctctctcatcattttacaatgacacaattgtgaactgcccaacatgctcttgtggctgccaaaatccaactggctcaaactgtgtgaatgaggattcaccgaatctacaatcagcaattgatggccctgggaaatggactggtcagcctcttgtacaatgcacctcccacatgtgcccgataagaatccactggcatgtgaagctcaattacaaggaatactggagagtgaaaataactatcaccaacttcaacttccgcatgaattacacgcaatggaacttagttgttcagcatccaaactttgataatatcactcagctgttcagtttcaactacaaaccacttaccccatatggtggtggcataaatgatacggcaatgttctggggtgtaaaattctacaatgatttgctgatgcaagctggtaaacttgggaatgtgcaatcagaactacttcttcgaaaggattctcaggctttcaccttcgaaaagggatgggccttcccacgtcgagtgtacttcaatggtgataactgtgtcatgccgtcccctgaaaattatccatggctgcccaatgcaagccctctaacaaaacaaccattgacactcccactctttgtattctgggttgtgttggctactctgttggcttatgcatgatgagtgggatcaagagatttagcgagcttcaagttgatgtcagattccatgaggtgcactgcaacaggccatttgttcattcaattccatggttgcacttcttaatgaaaaacgtgctcaggcacggtcgcg

SEQ ID NO: 180 - protein, 449 aa, Panicum virgatum
  misc_feature (54)..(218): Pfam Name: Phytochel_synth Pfam Description: Phytochelatin synthetase-like
  misc_feature: Ceres Clone ID no. 1902642
  misc_feature: Bit score of 935.1 for HMM based on sequences of Figure 3
  misc_feature: Functional Homolog Of SEQ ID NO. 117
MAPGGRSVACCAAVLLAAALLLSAPTATEAYDSLDPNGNITIKWDIMQWTPDGYVAVVTMFNYQQFRHIGAPGWQLGWTWAKKEVIWSMVGAQTTEQGDCSKFKGNTPHCCKKDPTLVDLLPGTPYNMQIANCCKAGVINTFNQDPANAASSFQISVGLAGTTNKTVKVPKNFTLKTPGPGYTCGRAIVGRPTKFFTSDGRRATQALMTWNVTCTYSQFLAQKTPSCCVSLSSFYNDTIVNCPTCSCGCQNPTGSNCVNEDSPNLQSAIDGPGKWTGQPLVQCTSHMCPIRIHWHVKLNYKEYWRVKITITNFNFRMNYTQWNLVVQHPNFDNITQLFSFNYKPLTPYGGGINDTAMFWGVKFYNDLLMQAGKLGNVQSELLLRKDSQAFTFEKGWAFPRRVYFNGDNCVMPSPENYPWLPNASPLTKQPLTLPLFVFWVVLATLLAYA

SEQ ID NO: 181 - DNA, 1350 bp, Sorghum bicolor
  misc_feature: Ceres Annot ID no. 8632643
  misc_feature: Encodes the peptide sequence at SEQ ID NO. 182
atggcggcgggcggcagatccgtcgcgtgctgtgccgccgtgctgctcgcggccgcgctgctcctctccgcaccgactaccacagaggcttatgattcgctggatccaaccggcaacatcactataaaatgggatattatgcagtggactcctgacggatatgtcgctgttgtcacaatgtataattttcaacaatttcggcacatcggcgcacctggttggcagcttgggtggacatgggcaaagaaggaggttatatggtcaatggttggggctcagaccactgaacagggtgactgctcaaagttcaagggcaacaccccccattgctgcaagaaagatccaacaattgtcgatttactaccaggcactccatacaacatgcaaattgccaattgctgcaaggcaggagtcataaatacctttaaccaggacccagcaaatgctgcttcctccttccagatcagtgttggtcttgccggaactaccaataaaactgttaaggtgccaaagaacttcactcttaagactccaggccctgggtacacatgtgggcgtgccattgttggcaggccgacaaagttttggagcgcagatgggcgcagggcaacccaagctctaatgacatggaatgtgacctgcacatattcccaatttcttgctcagaagactccatcctgctgtgtctctctctcatcgttttataatgacacaattgtgaactgcccaacatgctcatgtggctgccagaacccaagtgggtcaaactgtgtgaatgaggattcacctaatctacaagctgcaattgatggtcctggcaaatggactggccagcctcttgtacaatgcacttcccacatgtgcccgataagaatccactggcatgtgaagctcaactacaaggaatactggagagtgaaaatcactatcacaaacttcaacttccgcatgaattacacgcagtggaacttagtagctcagcatccaaactttgataacatcactcagttgttcagcttcaactacaaaccacttactccatatgggggtggcataaatgatacggcaatgttctggggtgtaaaattctacaatgatttgctgatgcaagccggcaaacttggaaatgtgcaatcggaactgcttctccgcaaggactcccggactttcaccttcgataaggggtgggccttcccacgccgggtgtacttcaatggtgataattgtgtcatgccatctcctgaaaattatccatggctgccgaatgcaagccctctaacaagacaaccattgacactcccactcttggtattctgggttgccttggctgctctgttggcttatgcatga

SEQ ID NO: 182 - protein, 449 aa, Sorghum bicolor
  misc_feature (54)..(218): Pfam Name: Phytochel_synth Pfam Description: Phytochelatin synthetase-like
  misc_feature: Ceres Annot ID no. 8632643
  misc_feature: Bit score of 933.1 for HMM based on sequences of Figure 3
  misc_feature: Functional Homolog Of SEQ ID NO. 117
MAAGGRSVACCAAVLLAAALLLSAPTTTEAYDSLDPTGNITIKWDIMQWTPDGYVAVVTMYNFQQFRHIGAPGWQLGWTWAKKEVIWSMVGAQTTEQGDCSKFKGNTPHCCKKDPTIVDLLPGTPYNMQIANCCKAGVINTFNQDPANAASSFQISVGLAGTTNKTVKVPKNFTLKTPGPGYTCGRAIVGRPTKFWSADGRRATQALMTWNVTCTYSQFLAQKTPSCCVSLSSFYNDTIVNCPTCSCGCQNPSGSNCVNEDSPNLQAAIDGPGKWTGQPLVQCTSHMCPIRIHWHVKLNYKEYWRVKITITNFNFRMNYTQWNLVAQHPNFDNITQLFSFNYKPLTPYGGGINDTAMFWGVKFYNDLLMQAGKLGNVQSELLLRKDSRTFTFDKGWAFPRRVYFNGDNCVMPSPENYPWLPNASPLTRQPLTLPLLVFWVALAALLAYA

SEQ ID NO: 183 - DNA, 1845 bp, Zea mays
  misc_feature: Ceres Clone ID no. 236876
  misc_feature: Encodes the peptide sequence at SEQ ID NO. 184
gagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgcaaccgtagccgccgcactacggagcaagatcgtcgggtagacggacgggcgggcgggcgggcgcggctctgtatctatctgtcggtgggagaccgcgtgtgtcggttaggcggcgggtggcaaggaagaatggcggcgagcggcagatccgtcgcgtgctgtgccgccgcgctgctcgcggccgcgttgctcctctccgcaccgactgcaacagaggcttatgattcgctggatccaaatggcaacatcaccataaaatgggatatcatgcagtggactcctgatggatatgtcgctgttgtcacaatgtttaattatcaacaatttcggcatatcggcgcacctggttggcagcttgggtggacatgggcaaagaaggaggttatatggtcaatggttggggctcagaccactgaacagggcgactgctcaaagttcaagagcagcccaccccattgctgcaagaaagatccaacaattgtcgatttacttccaggcactccatacaacatgcaaattgccaattgctgcaaggcaggagttgtaaatacctttaaccaggacccagcaaatgctgcttcctccttccagatcagtgttggtcttgctggaactaccaataaaactgttaaggtgcccaggaacttcactcttaagactccaggccctgggtacacatgtgggcgtgccattgttggcaggcctacgaagtttttcaccgcggacgggcgcagggcaacccaagctctaatgacatggaatgtgacctgcacatattcccaatttcttgctcagaagactccatcctgctgtgtatctctatcatcgttttataatgacacaattgtgaactgcccaacatgctcatgtggctgccagaacccaagtgggtcaaactgtgtgaatgaggattcacctaatctacaagctgcaattgatggccctggcaaatgcactggtcagccccttgtacaatgcacttcccacatgtgcccgataagaatccactggcatgtgaagctcaactacaaggattactggagagtgaaaatcactatcacaaacttcaacttccgcatgaattacacgcagtggaacttagtagcccagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggccttcccacgccgagtttacttcaatggtgataattgtgtcatgccatctcctgaaaattatccatggctgccgaatgcaagccctctaacaaaaccattggcactcccattcttggtattctgggttgccttggctgctctgttggcttatgcatgattagtgggatcaagaggtttagcaagtttcaagttgatgtcagattccatgaggtgcactgcaacaagtcatttgttcattcaattccatggttgcacagaaaagatgaggcgatgccaagaaaaagtcgatatgtctatgtgtttaagttaaagggccaaaatgtatttcttgtttggtatataacagccctacaacactttggtgaactg

SEQ ID NO: 184 - protein, 448 aa, Zea mays
  misc_feature (54)..(218): Pfam Name: Phytochel_synth Pfam Description: Phytochelatin synthetase-like
  misc_feature: Ceres Clone ID no. 236876
  misc_feature: Bit score of 928.6 for HMM based on sequences of Figure 3
  misc_feature: Functional Homolog Of SEQ ID NO. 117
MAASGRSVACCAAALLAAALLLSAPTATEAYDSLDPNGNITIKWDIMQWTPDGYVAVVTMFNYQQFRHIGAPGWQLGWTWAKKEVIWSMVGAQTTEQGDCSKFKSSPPHCCKKDPTIVDLLPGTPYNMQIANCCKAGVVNTFNQDPANAASSFQISVGLAGTTNKTVKVPRNFTLKTPGPGYTCGRAIVGRPTKFFTADGRRATQALMTWNVTCTYSQFLAQKTPSCCVSLSSFYNDTIVNCPTCSCGCQNPSGSNCVNEDSPNLQAAIDGPGKCTGQPLVQCTSHMCPIRIHWHVKLNYKDYWRVKITITNFNFRMNYTQWNLVAQHPNFDNITQLFSFNYKPLTPYGGGINDTAMFWGVKFYNDLLMQAGKLGNVQSELLLRKDSRTFTFEKGWAFPRRVYFNGDNCVMPSPENYPWLPNASPLTKPLALPFLVFWVALAALLAYA

SEQ ID NO: 185 - protein, 436 aa, Cleome spinosa
  misc_feature (40)..(204): Pfam Name: Phytochel_synth Pfam Description: Phytochelatin synthetase-like
  misc_feature: Public GI ID no. 90657629
  misc_feature: Bit score of 893.8 for HMM based on sequences of Figure 3
  misc_feature: Functional Homolog Of SEQ ID NO. 117
MAWSLDSSGLTLLQEAYDALDPDGNITIKWDIMTWTADGYVAVVTIYNFQQYRHIQAPGWSLGWTWAKREVIWGMNGGQTTEQGDCSRFKGNIPHCCKQDPTVVDLMPGTPYNQQIANCCKGGVINSFAQDPATTVSAFQLTVGQAGTTNKTVRVPKNFTLKAPGPGYTCSPGNIVKPSRFISADKRRITQALMTWNVTCTYSQFLAQKTPTCCVSLSSFYTNTIVSCPTCACGCRKTSETGTCVDPKGPRIASVIQSPGKNSYMPPLVQCTNHMCPIRIHWHVKVNYKEYWRVKISITNFNYVMNYSQWNVVVQHPNFDNLTQIFSFNYKPLTPYASINDTGILWGVKYYNDLLMQAGPSGNVQSELLFRKDPLSFTLEKGWAFPRRIYFNGDNCVMPPPDSYPRLPNFGSSLIGSRPVAVLTFLSVTAFLHRNL

SEQ ID NO: 186 - protein, 457 aa, Triticum monococcum
  misc_feature (59)..(223): Pfam Name: Phytochel_synth Pfam Description: Phytochelatin synthetase-like
  misc_feature: Public GI ID no. 30090032
  misc_feature: Bit score of 917.6 for HMM based on sequences of Figure 3
  misc_feature: Functional Homolog Of SEQ ID NO. 117
MAPVGGVAGSSRSAACCAVLLAAVLFFSAPATTEAYDSLDPNGNITIKWDIISWTPDGYVATVTMFNYQQFRHIPAPGWQLGWSWAKKEVIWSMVGAQATEQGDCSKFKSAPPHCCKRDPTIVDLLPGTPFNQQIANCCKAGVIKTFNQDPGNAASSFQISVGLAGTTNKTVKMPKNFTLRAPGPGYTCGRALVGRPTKYYSSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTALATLLAYYV

SEQ ID NO: 187 - DNA, 1380 bp, Sorghum bicolor
  misc_feature: Ceres Annot ID no. 8640602
  misc_feature: Encodes the peptide sequence at SEQ ID NO. 188
atggcgaggctgcgactcctactgctccggcatctggctgccgccgctgctctgctcgccggcttctcttctctgccacctttggcagaagcatatgatcctcttgatccaaatgggaatatcacaataaaatgggatatcattcagtggacttcagatggttatgttgctgttgtttccatatacaattaccataaataccgacatatccaagcacccgggtggaaccttggatgggtgtgggcaaagaaggagatcatctggaccatagttggcgggcagaccacagagcaaggggattgctctcagttcaaaggcagtataccacactgctgcaagagggatccagcagttgttgacttgcttcctgggacaccttacaacatgcaggatgcaaattgttgcaaaggaggagtgcttaactcatgggttcaagacccagtcagtgcagtggcatcgtttcagatcagtgtcggccgatctggtactaccaactacacagtgaaagcgccactaaacttcactctgaaggccccaggaccaggatacagttgtggagtagctcatgtggtgaagcctcctacgaagttcatttcccaggacggaaggagaaccactcaagctcatgtgacatggaacgtgacatgtacatattcccaatttgttgctcagcgggctccaacttgttgtgtttcactctcatcattttacaatgaaaccatagttaactgcccaaaatgttcatgtggctgtcagaataccagaccgggaagttgtgttgagggtgattcaccttatttggcttctgtcgtgaatggaccgggcaagagcagcatgactcctctagttcagtgcacgccccatatgtgcccgataagagtgcattggcatgttaagctcaactacagggaatactggagggtgaagatcacggttacaaactggaattaccggatgaattactcacaatggaacttggtagttcagcacccaaatttcgacaaagttaccactattttcagcttcaactacaagcctctgaacccctatggagtaataaatgatactggaatgctgtggggtatcaagtactacaatgacctgctcatggtggctgggccagatggaaatgtgcaatctgagcttctgttccggaaggacccgtcgacattcactttcgagaaaggctgggcgttcccaaggcggatatacttcaatggcgacagctgtgtcatgcctccaccagatgcgtacccatggctaccaaactcttcccctgtactcctactgaagagctcatccctcgttctgcccatcgtgatttggacggcgatgctgttcttacggcttggtatgtactcaatccatcccaaattgtaa

SEQ ID NO: 188 - protein, 459 aa, Sorghum bicolor
  misc_feature (55)..(220): Pfam Name: Phytochel_synth Pfam Description: Phytochelatin synthetase-like
  misc_feature: Ceres Annot ID no. 8640602
  misc_feature: Bit score of 896.0 for HMM based on sequences of Figure 3
  misc_feature: Functional Homolog Of SEQ ID NO. 117
MARLRLLLLRHLAAAAALLAGFSSLPPLAEAYDPLDPNGNITIKWDIIQWTSDGYVAVVSIYNYHKYRHIQAPGWNLGWVWAKKEIIWTIVGGQTTEQGDCSQFKGSIPHCCKRDPAVVDLLPGTPYNMQDANCCKGGVLNSWVQDPVSAVASFQISVGRSGTTNYTVKAPLNFTLKAPGPGYSCGVAHVVKPPTKFISQDGRRTTQAHVTWNVTCTYSQFVAQRAPTCCVSLSSFYNETIVNCPKCSCGCQNTRPGSCVEGDSPYLASVVNGPGKSSMTPLVQCTPHMCPIRVHWHVKLNYREYWRVKITVTNWNYRMNYSQWNLVVQHPNFDKVTTIFSFNYKPLNPYGVINDTGMLWGIKYYNDLLMVAGPDGNVQSELLFRKDPSTFTFEKGWAFPRRIYFNGDSCVMPPPDAYPWLPNSSPVLLLKSSSLVLPIVIWTAMLFLRLGMYSIHPKL

SEQ ID NO: 189 - protein, 458 aa, Oryza sativa subsp. japonica
  misc_feature (53)..(218): Pfam Name: Phytochel_synth Pfam Description: Phytochelatin synthetase-like
  misc_feature: Public GI ID no. 115453533
  misc_feature: Bit score of 894.2 for HMM based on sequences of Figure 3
  misc_feature: Functional Homolog Of SEQ ID NO. 117
MARFLLGAAAIALLAGVSSLLLMVPFAEAYDPLDPNGNITIKWDITQWTPDGYVAVVTIYNFQKYRHIQAPGWSLGWAWAKKEIIWSMAGGQATEQGDCSAFKANIPHCCKRDPRVVDLVPGAPYNMQFGNCCKGGVLTSWVQDPLNAVASFQITVGHSGTSNKTVKAPKNFTLKAPGPGYSCGLAQEVKPPTRFISLDGRRTTQAHVTWNVTCTYSQFVAQRAPTCCVSLSSFYNETIVNCPKCACGCQNKKPGSCVEGNSPYLASVVNGPGKGSLTPLVQCTPHMCPIRVHWHVKLNYRDYWRVKVTITNWNYRMNYSQWNLVVQHPNFENVSTVFSFNYKSLNPYGVINDTAMMWGVKYYNDLLMVAGPDGNVQSELLFRKDRSTFTFDKGWAFPRRIYFNGESCVMPSPDLYPWLPPSSTPRFRTVFLLMSFLVCGTLAFLHNHLVLDKNCGKC

SEQ ID NO: 190 - protein, 460 aa, Zea mays
  misc_feature (57)..(223): Pfam Name: Phytochel_synth Pfam Description: Phytochelatin synthetase-like
  misc_feature: Public GI ID no. 162462330
  misc_feature: Bit score of 900.6 for HMM based on sequences of Figure 3
  misc_feature: Functional Homolog Of SEQ ID NO. 117
MAPPPLLPARFVAASVALLAVAFSSSLTRPSGAYDPLDPNGNITIKWDVIQWTADGYVAVVSLYNYQQYRHIQAPPGWRLGWVWAKKEVIWAMTGGQATEQGDCSRFKASVLPHCCRRDPEVVDLLPGTPYNTQTANCCRGGVLASWAQDPSDAVASFQVSVGQAGSTNRTVKVPRNFTLLAPGPGYTCGAAKLVKPTKFMSQDGRRSTQAHMTWNVTCTYSQFLAQRSPTCCVSLSSFYNDTIVSCPACSCGCQNNNSSSTAAPGSCVEGSRRSPYLASVVNDPSKNSLAPLVQCTSHMCPVRVHWHVKVSYKEYWRVKITVTNFNYRMNYSQWNLVAQHPNFDNLTTIFSFNYRPLNPYGVINDTAMLWGIKYYNDLLMTAGPDGNVQSELLFRKEPSTFTFHKGWAFPRRVYFNGDNCVMPPPDAYPWLPNAASPRLSPSLLLPLVAAAWTAFAVLS

SEQ ID NO: 191 - protein, 456 aa, Triticum aestivum
  misc_feature (59)..(222): Pfam Name: Phytochel_synth Pfam Description: Phytochelatin synthetase-like
  misc_feature: Public GI ID no. 38230578
  misc_feature: Bit score of 900.3 for HMM based on sequences of Figure 3
  misc_feature: Functional Homolog Of SEQ ID NO. 117
MAPVGGVAGSSRSAACCAVLLAAVLFFSAPATTEAYDSLDPNGNITIKWDIISWTPDGYVATVTMFNYQQFRHIPAPGWQLGCSWAKKEVIWSMVGAQATEQGDCSKFKSAPPHCCKRDPTIVDLLPGTPFNQQIANCCKAGVIKTFNQDPGNAASSFQISVGLAGTTNKAVKMPKNFTLRAPGPGYTCGRALVGRPTKYYSDGRRVTQALMSWNVTCTYSQFLAQKTPTCCVSLSSFYNDTIVNCPTCSCGCQNNITRPGSCVNDNSPYLQSAINGPGKLTGQPLVQCTSHMCPIRIHWHVKLNYKDYWRVKVTITNFNYRMNYTDWNMVAQHPNFDNITKLFSFNYKPLTPYGGRINDTAMFWGMKFYNDLLNQAGPLGNAQSELLMRKDSETFTFQKGWAFPRRVYFNGDNCVMPSPDDYPWLPSASPLTKQPWTLPLLVFWTVLSTLLAYYV

SEQ ID NO: 192 - DNA, 1278 bp, Sorghum bicolor
  misc_feature: Ceres Annot ID no. 8632641
  misc_feature: Encodes the peptide sequence at SEQ ID NO. 193
atggcgacgggcggcagactggccgtcacttgctccgccgccgtgctgctcgccgtggcgctgctgatctccgcaccggacgccgcagaggcttatgattctctagatccaaacggcaacatcactataaaatgggatgttatgcaatggactcctgatggatatgtcgctgttgtcacaatgtacaattaccaacaatttcggcacattgggccacccggatggcagcttgggtggacatgggcaaagaaggaggttatatggtcaatggttggggctcaggccaccgaacagggtgactgctcaaagttcaagggcaacattcctcacagctgcaagaaagatcccgtgatcgttgatttacttccaagcacaccatatgacatgcaaattgccaattgctgcaaggcaggagttataagtacaattagtcaggatccagcaaatgctgcttcctcatttcagctcagtgtaggtctttctgggtctaccactaagactgtcaaggtgccgaagaacttcacccttaggactcctggccccggttacacctgtgggcgtgctattgttggcaagcctactatatttttctctgcagatggccgcagggcaaccaaagctctaatgacatggaatgtgacctgcacgtattcccaatttcttgctcagaagactccgtcctgctgtgtatctctttcatcgttttataacaacactactgtgaactgcccaacatgctcctgtggctgccagaacccaagtggatcaaactgtgtgaataagggttcgcctcgcctacgatctgctattgatggccctggcaaatggagtggcgagcctcttgtggagtgcacttcccacatgtgccccgtaaaaatcaactggcacgtgaagcagaacagcaaggactactggagagtgaagatcaccatcacaaacctcaacttccgaatgaactacagcgagtggaacctggttgttcagcatccaaacttcgataacatcactcagttgttcggcctcaactacaaaccactcactccatatgggggtgacataaatgacacggcaatgttctggggtgtgaagtcctacaatgatgtgctgatgcaagacggtaagcttgggatggtgcagtcagagctccttctccgtaaagactcccggactttcacattcgaaaagggatgggccttcccacgccgggtgtacttcaatggtgataactgtgtcatgccagctcctgaaaattacccatcgttgccaatgcaagcctag

SEQ ID NO: 193 - protein, 425 aa, Sorghum bicolor
  misc_feature (55)..(219): Pfam Name: Phytochel_synth Pfam Description: Phytochelatin synthetase-like
  misc_feature: Ceres Annot ID no. 8632641
  misc_feature: Bit score of 808.3 for HMM based on sequences of Figure 3
  misc_feature: Functional Homolog Of SEQ ID NO. 117
MATGGRLAVTCSAAVLLAVALLISAPDAAEAYDSLDPNGNITIKWDVMQWTPDGYVAVVTMYNYQQFRHIGPPGWQLGWTWAKKEVIWSMVGAQATEQGDCSKFKGNIPHSCKKDPVIVDLLPSTPYDMQIANCCKAGVISTISQDPANAASSFQLSVGLSGSTTKTVKVPKNFTLRTPGPGYTCGRAIVGKPTIFFSADGRRATKALMTWNVTCTYSQFLAQKTPSCCVSLSSFYNNTTVNCPTCSCGCQNPSGSNCVNKGSPRLRSAIDGPGKWSGEPLVECTSHMCPVKINWHVKQNSKDYWRVKITITNLNFRMNYSEWNLVVQHPNFDNITQLFGLNYKPLTPYGGDINDTAMFWGVKSYNDVLMQDGKLGMVQSELLLRKDSRTFTFEKGWAFPRRVYFNGDNCVMPAPENYPSLPMQA

SEQ ID NO: 194 - protein, 465 aa, Physcomitrella patens subsp. patens
  misc_feature (69)..(234): Pfam Name: Phytochel_synth Pfam Description: Phytochelatin synthetase-like
  misc_feature: Public GI ID no. 168016456
  misc_feature: Bit score of 760.2 for HMM based on sequences of Figure 3
  misc_feature: Functional Homolog Of SEQ ID NO. 117
MPVSILFAFYGSIWLLPSNLSRIVSVFSEFVCCNNIYLSTVADAGYDPIDPEGNITIKWDVVEWTGDGYRAIVTMSNWQLYRHIQAPGWIMGWTWATKKEVIWNMVGAETREQGDCSKFTGNLPHCCKRTPEVIDLLPGVPYNQQTANCCRGGVLSSYMQDPKTSVASFQVIVGNTGNKNTTIKLPQNFTIMTPGPGYTCSSAKVVPKTKFLSPSGRRITEAFMTWTVKCSYTEQLAHKAATCCVSFSAFYNETIVPCEKCACDCPTNNTTPIITTNGADTNNQRCINRTKNNNLQQQPDMLYCTNDMCPVKIHWHIKLNYQEYWRVKITITNRDISRNYTLWNLVARHPNFKNFTESFSFSYKPLTAYGPTNDTAIFWGVKYYNDMLMQAGPSGNVQSEILFRKDSAFTLANGWGFPSHVLFNGDHCVLPHADHYPTLPSSSSTLRAATTTIALLVLFAVALLI

SEQ ID NO: 195 - protein, 425 aa, Oryza sativa subsp. indica
  misc_feature (51)..(217): Pfam Name: Phytochel_synth Pfam Description: Phytochelatin synthetase-like
  misc_feature: Public GI ID no. 125532513
  misc_feature: Bit score of 660.7 for HMM based on sequences of Figure 3
  misc_feature: Functional Homolog Of SEQ ID NO. 117
MAIGVGGCCAVLLAAALLFSSPATTYAYDSLDPNGNITIKWDVMQWTPDGYAAVVTLSNYQQFRHIQPPGWQLGWTWQQKEVIWSMYGAQAIEQGDCSMSKEGSNVPHSCKKHPTVVDLLPGTPIDLQIANCCKAGSLSAFSQDPANSAASFQIIVGHSGNSNETVRVPKNFSLMAPGPGYTCSRAMIVKPSRFLSPDGRRATQALMTWNVICTYSQFLAQKVPSCCVSLSSFDNDKTVDCPTCSCGCRNEKSTTGKCVKKNAPDLQSIIHGPGRWTWQPLLQCTSHMCPVKINWHLMLKDKEHYRVKITVTNLNYRMNFTEWNLVVQYHPILDITQISGFNYKSIQVGKINDTTMLWGVKPYYDLLMQAGPLGNVQGELIVRKDFRASSTSNNNKGRAFPVRVYFNGDNCVMPPPDAYPVSITA

SEQ ID NO: 196 - protein, 437 aa, Vitis vinifera
  misc_feature (50)..(213): Pfam Name: Phytochel_synth Pfam Description: Phytochelatin synthetase-like
  misc_feature: Public GI ID no. 157354382
  misc_feature: Bit score of 638.0 for HMM based on sequences of Figure 3
  misc_feature: Functional Homolog Of SEQ ID NO. 117
MFFSLFTFMSPSCKIQLNFLIGNADGYDPLDPNGNIAIKWDVLQWSSSSYDARVSIINYQLYRHIETPGWKLSWTWPGDEVIWDMWGALAHEQGNCSEFKGEQLPYCCEKTPLILDRGPGTPFNKQVANCCRDGLLTSMIQDPSKHGAMFQMNVGTASSNVSDMTMPRNFSLGVPGYTCGDPFQVPPSRFPEEGGRRWTQALMTWNVSCSYSQFLASTAPTCCVSLSAFYNSTIVPCPQCSCGCEGIPGTKCAKPGETPLLLPQGDGQQPDLVRCSRHMCPIRVHWHVKTSYREYWRVKITVTNLNLVKNYSAWNLVVLHPNLQSITQVFSFNYRSLNEHGTINDTGMFWGIQYYNELLLQAGESGNVQTEMLLHKDPGIFTFREGWAFPRKISFNGDQCVMPSPDEYPRLPNTGPSATPPSLCIILLLSLSVIVML

SEQ ID NO: 197 - DNA, 1296 bp, Populus balsamifera subsp. trichocarpa
  misc_feature: Ceres Annot ID no. 1481980
  misc_feature: Encodes the peptide sequence at SEQ ID NO. 198
atgggcatggtcttgattttgatcttcttcttcttctatctcattagctctatatcaccttcttatgggtttgacccacttgatccttatggcaacataaccatcaaatgggatcttcttctatcgaattccggtacaaataatctgatggtatcaatttacaacttccaacaatatcgccatgtggaaccaccaggctggaaattgaattgggcatggaaaggcaaagaggtgatatggtcaatgcagggagctgaggctactgagcaaggaaactgcactgaattcaaggaatcaacccttcctcattgttgtgagaaggagccattcattgtagaccttcttcccggaaccaattataatgctcaaacccaaaattgttgcaagggaggtgtactgtcatccatgaagcaagatccttccaagtatgttgctacttttcagatggctgtcggaggttctggtaccaattcccaatttaaaatgccggaaaatttcaaacttggagttccaggctatagttgtgggggtgcagttaaggtagaacccagcaggtacacaacagatggaggccggcgatggacacaggctcttgcgacatggaatgtgacctgcatgtactcccagagtttagcatcacctacaccaagatgttgtgtttccttgtctgcattctacaatcaaactattgtttcgtgccccagatgcagctgcggctgccaaggacaacctggaacaaaatgtgtaaagtatggtgagaccccaccattgctgaaacaaaatcaagatccaacacctgtagtaaggtgctcagagcatatgtgcccaataagggtgcattggcatctgaaagaaagttacaaacaatattggagggctaaaatgacagttacaaatttccacatcatgaaaaattattcagaatggaacttggtggtgctacatcccaacctgcaaagtctgacacaggttttcagcttcaactacgcacccctcaatcgatacggatatatcaatgatactgggatgttttgggggcttcctttttacaatgacattttactacaagaaggaaaggatgggaatttacagactgaaattttactacgcaaagatccagggatttttactttcagagaaggttggggtttccctagaaagattcaatttaatggtgatgaatgtgtcatgcctccaccggatgaatatccatcgctgcccaacaaggggcatagtgcctctgctaccacacctttcataattcttttctctttgtttctcgcatttatgctctaa

SEQ ID NO: 198 - protein, 429 aa, Populus balsamifera subsp. trichocarpa
  misc_feature (48)..(207): Pfam Name: Phytochel_synth Pfam Description: Phytochelatin synthetase-like
  misc_feature: Ceres Annot ID no. 1481980
  misc_feature: Bit score of 637.4 for HMM based on sequences of Figure 3
  misc_feature: Functional Homolog Of SEQ ID NO. 117
MVLILIFFFFYLISSISPSYGFDPLDPYGNITIKWDLLLSNSGTNNLMVSIYNFQQYRHVEPPGWKLNWAWKGKEVIWSMQGAEATEQGNCTEFKESTLPHCCEKEPFIVDLLPGTNYNAQTQNCCKGGVLSSMKQDPSKYVATFQMAVGGSGTNSQFKMPENFKLGVPGYSCGGAVKVEPSRYTTDGGRRWTQALATWNVTCMYSQSLASPTPRCCVSLSAFYNQTIVSCPRCSCGCQGQPGTKCVKYGETPPLLKQNQDPTPVVRCSEHMCPIRVHWHLKESYKQYWRAKMTVTNFHIMKNYSEWNLVVLHPNLQSLTQVFSFNYAPLNRYGYINDTGMFWGLPFYNDILLQEGKDGNLQTEILLRKDPGIFTFREGWGFPRKIQFNGDECVMPPPDEYPSLPNKGHSASATTPFIILFSLFLAFML

SEQ ID NO: 199 - DNA, 1263 bp, Populus balsamifera subsp. trichocarpa
  misc_feature: Ceres Annot ID no. 1535466
  misc_feature: Encodes the peptide sequence at SEQ ID NO. 200
atgggcatggtcttgattttgatcttcttcttcttctatctcattagctctatatcaccttcttatgggtttgacccacttgatccttatggcaacataaccatcaaatgggatcttcttctatcgaattccggtacaaataatctgatggtatcaatttacaacttccaacaatatcgccatgtggaaccaccaggctggaaattgaattgggcatggaaaggcaaagaggtgatatggtcaatgcagggagctgaggctactgagcaaggaaactgcactgaattcaaggaatcaacccttcctcattgttgtgagaaggagccattcattgtagaccttcttcccggaaccaattataatgctcaaacccaaaattgttgcaagggaggtgtactgtcatccatgaagcaagatccttccaagtatgttgctacttttcagatggctgtcggaggttctggtaccaattcccaatttaaaatgccggaaaatttcaaacttggagttccaggctatagttgtgggggtgcagttaaggtagaacccagcaggtacacaacagatggaggccggcgatggacacaggctcttgcgacatggaatgtgacctgcatgtactcccagagtttagcatcacctacaccaagatgttgtgtttccttgtctgcattctacaatcaaactattgtttcgtgccccagatgcagctgcggctgccaaggacaacctggaacaaaatgtgtaaagtatggtgagaccccaccattgctgaaacaaaatcaagatccaacacctgtagtaaggtgctcagagcatatgtgcccaataagggtgcattggcatctgaaagaaagttacaaacaatattggagggctaaaatgacagttacaaatttccacatcatgaaaaattattcagaatggaacttggtggtgctacatcccaacctgcaaagtctgacacaggttttcagcttcaactacgcacccctcaatcgatacggatatatcaatgatactgggatgttttgggggcttcctttttacaatgacattttactacaagaaggaaaggatgggaatttacagactgaaattttactacgcaaagatccagggatttttactttcagagaaggttggggtttccctagaaagattcaatttaatggtgatgaatgtgtcatgcctccaccggatgaatatccatcgctgcccaacaaggggcatagtgcctctaaggtattaccgacaaaataa

SEQ ID NO: 200 - protein, 418 aa, Populus balsamifera subsp. trichocarpa
  misc_feature (48)..(207): Pfam Name: Phytochel_synth Pfam Description: Phytochelatin synthetase-like
  misc_feature: Ceres Annot ID no. 1535466
  misc_feature: Bit score of 618.3 for HMM based on sequences of Figure 3
  misc_feature: Functional Homolog Of SEQ ID NO. 117
MVLILIFFFFYLISSISPSYGFDPLDPYGNITIKWDLLLSNSGTNNLMVSIYNFQQYRHVEPPGWKLNWAWKGKEVIWSMQGAEATEQGNCTEFKESTLPHCCEKEPFIVDLLPGTNYNAQTQNCCKGGVLSSMKQDPSKYVATFQMAVGGSGTNSQFKMPENFKLGVPGYSCGGAVKVEPSRYTTDGGRRWTQALATWNVTCMYSQSLASPTPRCCVSLSAFYNQTIVSCPRCSCGCQGQPGTKCVKYGETPPLLKQNQDPTPVVRCSEHMCPIRVHWHLKESYKQYWRAKMTVTNFHIMKNYSEWNLVVLHPNLQSLTQVFSFNYAPLNRYGYINDTGMFWGLPFYNDILLQEGKDGNLQTEILLRKDPGIFTFREGWGFPRKIQFNGDECVMPPPDEYPSLPNKGHSASKVLPTK

SEQ ID NO: 201 - DNA, 1365 bp, Arabidopsis thaliana
  misc_feature: Ceres Annot ID no. 1297618
  misc_feature: Encodes the peptide sequence at SEQ ID NO. 202
atgggtgcaatgctaaatcttttgctcgtcgttactgtcattctctgttcaatcttatcacccacacggtttatgattatgattgataaaatggttgcagatggatacgatcctcttgatccgttcggaaaaatcattatcaaatgggatcttcttttatcatcacctggccaacaccacgtacaagtaacgttagagaacatgcaagagtatcgacacgtggaaaagccagggtggaagcttagctggcattggctcaaccaagaagtgatatgggacatgaaaggagctgagacgacggagcaaggtaattgctctgcctttgcctccagcggtaaccttcctcactgctgtctcgagcgaccaaccatagtcgaccttcttcccggtgcttctctcaacgttcaagttgccaattgttgccgtggaggcgtcttgacttccatgtctcaggaccacgccaatcacgtctctgcttttcacatgacagttggaagctctcctgatggccctgaggagttcaatatgccttctaatttcgatataggggtcccgggttatagctgcgacaatgctacatccgtgtccccgactaagtttagtactgataagggccgtcgcaaaacacaagctctagcaacatgggaggcagtgtgtgtatactcgcagtttcggtcatcaccatcgccaaaatgctgcgtttcactctctgccttctactaccaaaacattgttccttgtcctacctgtagctgcggctgctcgagttcccattgtgtcaaggatggagagttgccgccatatcttgaacagaaacatgatccagatgaggaagtatcgcctgtcgtgaagtgttcggatcatatgtgtcccatccgcatccactggcatgtgaaagtgaactatagagagtattggagggttaagatcacagcaacaaatttcaacacaatgaagaattacactaattggaacttagtggtgcttcatccaaacttgaaaagcgtccaacaagtctttagctttaactacaaatctttgacaccatatcaaaacagcatcaatgacacagggatgttttggggagtccagttttataatgatgttttgcttcaagaaggaaagattgggaatgttcaaacagagttattgctgaagaaggatatgggaaatttcactttcagagaaggttgggctttcccaaggagaatcttgttcaatggtgatgaatgtgttatgccttctccagatgactttccaaggctgccaaaatctgctcattcctcttcgtcttcctctgctgttattagctctgtttcagtcgttttctgttttctccttcatcatcttcttctactagtttga

SEQ ID NO: 202 - protein, 454 aa, Arabidopsis thaliana
  misc_feature (59)..(223): Pfam Name: Phytochel_synth Pfam Description: Phytochelatin synthetase-like
  misc_feature: Ceres Annot ID no. 1297618
  misc_feature: Bit score of 629.4 for HMM based on sequences of Figure 3
  misc_feature: Functional Homolog Of SEQ ID NO. 117
MGAMLNLLLVVTVILCSILSPTRFMIMIDKMVADGYDPLDPFGKIIIKWDLLLSSPGQHHVQVTLENMQEYRHVEKPGWKLSWHWLNQEVIWDMKGAETTEQGNCSAFASSGNLPHCCLERPTIVDLLPGASLNVQVANCCRGGVLTSMSQDHANHVSAFHMTVGSSPDGPEEFNMPSNFDIGVPGYSCDNATSVSPTKFSTDKGRRKTQALATWEAVCVYSQFRSSPSPKCCVSLSAFYYQNIVPCPTCSCGCSSSHCVKDGELPPYLEQKHDPDEEVSPVVKCSDHMCPIRIHWHVKVNYREYWRVKITATNFNTMKNYTNWNLVVLHPNLKSVQQVFSFNYKSLTPYQNSINDTGMFWGVQFYNDVLLQEGKIGNVQTELLLKKDMGNFTFREGWAFPRRILFNGDECVMPSPDDFPRLPKSAHSSSSSSAVISSVSVVFCFLLHHLLLLV

SEQ ID NO: 203 - protein, 444 aa, Zea mays
  misc_feature (49)..(224): Pfam Name: Phytochel_synth Pfam Description: Phytochelatin synthetase-like
  misc_feature: Public GI ID no. 119040466
  misc_feature: Bit score of 590.5 for HMM based on sequences of Figure 3
  misc_feature: Functional Homolog Of SEQ ID NO. 117
MGRFVFVLLILMCCSSSRFTGAYDPIDPNGNITIVWDFQSLDVAGMTPYTVMVSIHNYQMYRHIERPGWRLSWSWAGKEVIWSTTGAETTEQGDCSRVGSGGSRPHCCQKRPVMVDLPPGTPYNMQVANCCRGGVLSSLVQSDLTSAAAFQMVVGEFALARDSGGKEPEKPWQFDMGVPGYTCSNATTVAPTRIKVDKNRYVQALQDRAELRAVTWQVTCSYSQYRASAAPSCCVSMTTFYSETIVDCPRCSCGCQGSPPSPQCVSVDQQQPWLPAVGDDEPSSAPIVWCSEHMCPIRVHWHVKTNYRKYWRVKVTVSNYNLARNYSDWNLVLQHPNLRSLTQLFSFNYRPLVEYGAYNDTGMFWGLRYYNEMLLQDGNVQSEMILEKESDFTYSGGWAFPRRVYFNGQECVMPPADQYPVLPNGASALRGHFCFLLLLFFVVV

SEQ ID NO: 204 - protein, 437 aa, Oryza sativa subsp. indica
  misc_feature (45)..(212): Pfam Name: Phytochel_synth Pfam Description: Phytochelatin synthetase-like
  misc_feature: Public GI ID no. 116310381
  misc_feature: Bit score of 603.0 for HMM based on sequences of Figure 3
  misc_feature: Functional Homolog Of SEQ ID NO. 117
MDVDQLILFVFVCCLSSRFADAYDPVDPNGNIIINWDFQSIENVYTVMVSVHNHQLYRHIEQPGWRLSWRWAGNEIIWGMTGAEATEQGDCHRIRGATRPHCCEKQPVIVDLPPGTPYNNQVSSCCRGGVLSSLTQNNRTSTAAFQMVVGGFRRATYHDGDRGPALPSRFGVGVPGYSCSNATKVNATRSPIGRHRHVQSLLTWQVTCTYSQFMEAASPTCCVSLSSFYNSTIVPCPRCSCGCPRSPTAPQCISEGEKPELPAGDGEAVAPVFRCTDHMCPVRVHWHVKISYREYWRVKVTITNYNQVKNYSDWNLVVQHPNLRSLTQLFSFNYQPLIEYGTLNDTGMFWGIQYYNEMMLQDGNVQTEMILKKDKSDFTFSGGWAFPRRVYFDGHECVMPPPDQYPLLPNGGPDSRVSAAQLIASSCLLLPFIFLIM

SEQ ID NO: 205 - DNA, 1329 bp, Sorghum bicolor
  misc_feature: Ceres Annot ID no. 8702104
  misc_feature: Encodes the peptide sequence at SEQ ID NO. 206
atggccgcgcaatccgcgattattgctgatcgttttcaccgcgtcgaatcagatgcctacgaccccgtagatccgaacgggaacatcacgatcaactgggattttcaggtcctcaacgtcaaggacatgtccccgtacacggtcatggtgagcatccacaactaccagatgtaccggcacatcgagcacccggggtggcggctgagctggaactggaccggcaaggaggtcatctggaacacggtgggcgcggagacgacggagcagggcgactgctcccgcgtcggcgccgccaacgcccgcccgcattgctgcctgaggcggcccgtcatggtggacctcccgcccggcaccccgtacaacaggcaggtcgccaactgctgccgcggcggcgtgctgtcgtccttcgtccagaacaatctgacgtccaccgccgcgttccagatggtcgtcggcgagttcgccctcgccaaggacgacggcggcggtagtatggagcccgagaagccgtggcatttcgacatcggcgtgccagggtacacctgcagcaacgccaccacggtagccccgaccagggtcaaggtcgacaagaaccgctacgaacaagtgctcctgacatggcaggtgacctgctcgtactctcagtaccgggcgtcgggggtgccgtcgtgctgcgtctccatgtcgacgttctacagcgagacgatcgtggattgcccgcgctgcagctgcgcctgccaagggtccccaacgccaacgtcgccacaatgcgtcagcgtcgaccaaccacggacaccagcgttgccggcgagcagcgacgacgagccggcggcgccgatcgtctggtgctcggagcacatgtgcccgatccgggtgcactggcacgtgaaggtgaactaccggcagtactggcgggtgaaagtgacggtgtccaactacaacctggtgaagaactacagcgactggaacctggtgctgcagcaccccaacctgcggagcctcacgcagctgttcagcttcaattacaagcctctcgtcgagtacggcagcttcaatgacacggggatgttctgggggttacgtttctacaacgagatgctgctgcaggacgggaacgtgcagacggagatgattctggagaaggagagcgacttcacctattccggcggctgggcgttcccgaggagggtctacttcaacggccaagagtgcgtcatgccgccggcggaccagtaccccaaactgcccaacggggcctcggaattgcgggggtcgtcgctgatcgccggcaattgcttgctgctgctattcttcttcgttctcgtgtag

SEQ ID NO: 206 - protein, 442 aa, Sorghum bicolor
  misc_feature (46)..(215): Pfam Name: Phytochel_synth Pfam Description: Phytochelatin synthetase-like
  misc_feature: Ceres Annot ID no. 8702104
  misc_feature: Bit score of 589.8 for HMM based on sequences of Figure 3
  misc_feature: Functional Homolog Of SEQ ID NO. 117
MAAQSAIIADRFHRVESDAYDPVDPNGNITINWDFQVLNVKDMSPYTVMVSIHNYQMYRHIEHPGWRLSWNWTGKEVIWNTVGAETTEQGDCSRVGAANARPHCCLRRPVMVDLPPGTPYNRQVANCCRGGVLSSFVQNNLTSTAAFQMVVGEFALAKDDGGGSMEPEKPWHFDIGVPGYTCSNATTVAPTRVKVDKNRYEQVLLTWQVTCSYSQYRASGVPSCCVSMSTFYSETIVDCPRCSCACQGSPTPTSPQCVSVDQPRTPALPASSDDEPAAPIVWCSEHMCPIRVHWHVKVNYRQYWRVKVTVSNYNLVKNYSDWNLVLQHPNLRSLTQLFSFNYKPLVEYGSFNDTGMFWGLRFYNEMLLQDGNVQTEMILEKESDFTYSGGWAFPRRVYFNGQECVMPPADQYPKLPNGASELRGSSLIAGNCLLLLFFFVLV

SEQ ID NO: 207 - protein, 433 aa, Vitis vinifera
  misc_feature (40)..(203): Pfam Name: Phytochel_synth Pfam Description: Phytochelatin synthetase-like
  misc_feature: Public GI ID no. 157340500
  misc_feature: Bit score of 535.8 for HMM based on sequences of Figure 3
  misc_feature: Functional Homolog Of SEQ ID NO. 117
MFFNKLFYSFSVFADCYDPLDPNGNITITFDTHKWTDDGYVARVTIQNYYQYRHVEKQGWKLGWTWAKDEVIWSMSGAFATQQGNCSSFIVQTPHSCLKNPVIVDLEPTAAPENMTEDCCHGGILSAWAIIPSNSFSSFEIMVGNLEGNTHGNKPLNLTLMAPGPGYTCSPIEDTDPTVSLVIGGRREIQVFRTWKSTCTYSTFLSNKVPVCCVSLSTFYSPTITTCPQCSCGCRDANPSTDSCIREGSSLSQLSSSGKLDIVQCTDHMCPIRVHWHVKNNYMSHWRVKLTISNYNLAKNYSDWNILVQHPGFSQNTTTYSFNSTALPTVGFADEIALFWGVTFYNNELLHADDKKLGSVTTEILLGKDSNSFTLNGGWAFPRRIYFNGENCEMPLPDTYPMLPNGSSTQKLTHPQFFLLLLCLTVKVLAIWL

SEQ ID NO: 208 - DNA, 576 bp, Arabidopsis thaliana
  misc_feature: Ceres Annot ID no. 847799
  misc_feature: Encodes the peptide sequence at SEQ ID NO. 209
atgtcttcggatcgtcacacaccgacgaaagatccaccggatcatccgtcttcttcctccaaccaccacaagcaaccacttcctcctcaaccgcagcaaccactcagccgctatgaatcgcagaaacgccgcgactggaacacgttcgtccaatacctaaaatcacaaaatccaccgttgatgatgtctcaattcgactacacgcacgtgctaagtttcctaaggtacttagatcagtttggtaagaccaaagtacatcatcaagcttgtgtcttcttcggacaaccggatccaccaggtccgtgcacgtgtcctctcaaacaagcttggggaagcctagatgctttgatcggacggctaagagctgcttacgaggaacacggtggcgggtcacctgatactaacccgtttgcaaacgggtcgatccgggttcacttgagggaagtgagagaatctcaagccaaggctcgtgggattccgtacaggaagaagaaaaggaggaagactaaaaacgaggtcgttgttgtcaagaaggatgttgcaaactcttcgactcctaatcagtcgttcacttga

SEQ ID NO: 209 - protein, 191 aa, Arabidopsis thaliana
  misc_feature (19)..(152): Pfam Name: DUF640 Pfam Description: Protein of unknown function (DUF640)
  misc_feature: Ceres Annot ID no. 847799
  misc_feature: Locus ID no. At4G18610
  misc_feature: Bit score of 353.9 for HMM based on sequences of Figure 10
MSSDRHTPTKDPPDHPSSSSNHHKQPLPPQPQQPLSRYESQKRRDWNTFVQYLKSQNPPLMMSQFDYTHVLSFLRYLDQFGKTKVHHQACVFFGQPDPPGPCTCPLKQAWGSLDALIGRLRAAYEEHGGGSPDTNPFANGSIRVHLREVRESQAKARGIPYRKKKRRKTKNEVVVVKKDVANSSTPNQSFT

SEQ ID NO: 210 - protein, 226 aa, Picea sitchensis
  misc_feature (25)..(157): Pfam Name: DUF640 Pfam Description: Protein of unknown function (DUF640)
  misc_feature: Public GI ID no. 116780542
  misc_feature: Bit score of 354.7 for HMM based on sequences of Figure 10
  misc_feature: Functional Homolog Of SEQ ID NO. 209
MSAEVVVGQGGSSATAAQLAPSSSSNGINEGSRELAASPAPSRYESQKRRDWNTFGQYLKNHRPPLALPRCSGAHVVEFLHYLDQFGKTKVHVPACPFFGHPHPPAPCACPLRQAWGSLDALIGRLRAAYEENGGKPESNPFGARAVRLYLREVRESQAKARGIAYEKRNASAPQFNSNNSSSNNMYSSTSTSTSTSTSTSSISSTSTSSKLRLTLCPTIPIQMSL

SEQ ID NO: 211 - DNA, 919 bp, Gossypium hirsutum
  misc_feature: Ceres Clone ID no. 1848017
  misc_feature: Encodes the peptide sequence at SEQ ID NO. 212
attcctttcacctcccctttccccagcccccttataatttcttcttgccttatttagcaaaagataattaatcaatctgcctcgatctcaacaatatgtcgagtgaaagagggaaggatatagcggaaggaccatcaagggttaatcccggtgatcaacagctgcccccaacacctagccgctatgagtcacagaagagaagggactggaatactttcgggcagtacctgaagaaccagaggcccccagttcctctttctcagtgcaactgcaaccatgtgctggacttccttcgatatctggatcagttcggaaagaccaaggttcacctgcagggatgcatgttctatggacagcctgagccgcctgctccttgcacatgcccccttaggcaagcctggggcagcctcgatgctctaattgggaggcttcgagctgcttatgaagagaatggagggtcacctgagaccaacccttttgccagcggtgctattcgggtttatctcagagaggtcagggagtgtcaagccaaggcaagggggatcccttataagaagaaaaagaagaagccgcatcaaggcaagggaggtgatgaatccagctccaccattcacttctcttaatctttggacgatgtatgggattacatgagaaaaagaatcaaatggaagggaatataatatgataaaatccatcgaagattcagctcagtttgggggtttcggccttctttattagtatttttctttttcggtatttggcaatagctataatgaagggatcagttgagtgtacataactctcttgatcagtttctactttgtttgcgttttctcttttcatgaatgtccattttatgtctaagcttcctacgcaaaacattcatatcgtattgataataattagtcattttagtcgt

SEQ ID NO: 212 - protein, 175 aa, Gossypium hirsutum
  misc_feature (11)..(143): Pfam Name: DUF640 Pfam Description: Protein of unknown function (DUF640)
  misc_feature: Ceres Clone ID no. 1848017
  misc_feature: Bit score of 373.1 for HMM based on sequences of Figure 10
  misc_feature: Functional Homolog Of SEQ ID NO. 209
MSSERGKDIAEGPSRVNPGDQQLPPTPSRYESQKRRDWNTFGQYLKNQRPPVPLSQCNCNHVLDFLRYLDQFGKTKVHLQGCMFYGQPEPPAPCTCPLRQAWGSLDALIGRLRAAYEENGGSPETNPFASGAIRVYLREVRECQAKARGIPYKKKKKKPHQGKGGDESSSTIHFS

SEQ ID NO: 213 - DNA, 534 bp, Populus balsamifera subsp. trichocarpa
  misc_feature: Ceres Annot ID no. 1466494
  misc_feature: Encodes the peptide sequence at SEQ ID NO. 214
atgtcaggtgatcaaaggcctaaagattctgctgagggctcttcacgatctggcggcgatcactaccagcctcaaccggctcctttgagcaggtatgagtcgcagaaacggcgagactggaacacttttgggcagtacttgaagaatcagagacccccagtttcactatctcagagtaattgcaaccacgtccttgatttccttcggtatctcgatcagtttggcaagactaaggtccatctacatggctgtgtcttttttggacaacctaatcctcctgctccttgtacctgccctctaaggcaagcttggggaagccttgatgccctaatcggacggcttcgagcagcttatgaggagcatggaggatctgcagagactaacccttttggaaatggagctattcgggtttatttgcgtgaagtgaaagagtgccaagctaaggcaagggggattccatacaagaagaaaacgaagaagaagactcaaataagggcaagaaatgaagcgaagcctcctatgcagtcagcttaa

SEQ ID NO: 214 - protein, 177 aa, Populus balsamifera subsp. trichocarpa
  misc_feature (13)..(145): Pfam Name: DUF640 Pfam Description: Protein of unknown function (DUF640)
  misc_feature: Ceres Annot ID no. 1466494
  misc_feature: Bit score of 368.7 for HMM based on sequences of Figure 10
  misc_feature: Functional Homolog Of SEQ ID NO. 209
MSGDQRPKDSAEGSSRSGGDHYQPQPAPLSRYESQKRRDWNTFGQYLKNQRPPVSLSQSNCNHVLDFLRYLDQFGKTKVHLHGCVFFGQPNPPAPCTCPLRQAWGSLDALIGRLRAAYEEHGGSAETNPFGNGAIRVYLREVKECQAKARGIPYKKKTKKKTQIRARNEAKPPMQSA

SEQ ID NO: 215 - DNA, 534 bp, Populus balsamifera subsp. trichocarpa
  misc_feature: Ceres Annot ID no. 1449022
  misc_feature: Encodes the peptide sequence at SEQ ID NO. 216
atgtcaggtgatcaaaggcctaaagattctgctgaaggctcttcgcgatctggaggcgatcaccaccagcttcaatcagctcctttgagccggtatgagtcgcagaaacggcgagactggaacactttcgggcagtacttgaagaatcagagacccccagtttcattatctcagtgtaattgcaatcatgtgcttgatttccttcggtatcttgatcagtttggcaagactaaggttcatctacatgggtgcgtcttctttggacaacctgatcctcctgctccttgtacatgccctctaaggcaagcttgggggagccttgatgccctaatcggacgccttcgagcagcttttgaggagcatggaggatcagcggagactaacccttttggaaatggagctattcgggtttatttgcgtgaagtgaaagagtgtcaagctaaggcaagagggattccttacaagaagaagaagaagaagaagactcaaataaggccaagagacgaagcaaagccttcgatgcagacagcttaa

SEQ ID NO: 216 - protein, 177 aa, Populus balsamifera subsp. trichocarpa
  misc_feature (13)..(145): Pfam Name: DUF640 Pfam Description: Protein of unknown function (DUF640)
  misc_feature: Ceres Annot ID no. 1449022
  misc_feature: Bit score of 365.2 for HMM based on sequences of Figure 10
  misc_feature: Functional Homolog Of SEQ ID NO. 209
MSGDQRPKDSAEGSSRSGGDHHQLQSAPLSRYESQKRRDWNTFGQYLKNQRPPVSLSQCNCNHVLDFLRYLDQFGKTKVHLHGCVFFGQPDPPAPCTCPLRQAWGSLDALIGRLRAAFEEHGGSAETNPFGNGAIRVYLREVKECQAKARGIPYKKKKKKKTQIRPRDEAKPSMQTA

SEQ ID NO: 217 - DNA, 531 bp, Populus balsamifera subsp. trichocarpa
  misc_feature: Ceres Annot ID no. 1482911
  misc_feature: Encodes the peptide sequence at SEQ ID NO. 218
atgtcaagcaataaagggaaagatgtagcggaaggttcatcaagagctgttgctatggctcccgatcagcaaaatccacctcccttgagtcgatacgaatcgcagaagaggcgcgattggaacacctttggtcagtacttgaggaaccagagacccccagttgcattatcacagtgcaacgcaaatcatgtgcttgaatttcttcgatacctcgatcaatttggcaagactaaggtgcacttacaagggtgtgtcttttttggacaacctgagccgccagggccctgtacttgcccacttaagcaagcctggggtagccttgatgcactcatcggccggcttagggctgcttatgaagaaaatggtggcttgcctgagacaaacccttttgcaagtggtgctattagagtatatctacgtgaagtgagggactctcaggccaaggcaagaggaattccttataagaagaagaagaagaagaggaatccgatgaaagctaacgatgagagctcaagctttcatatgcagtaa

SEQ ID NO: 218 - protein, 158 aa, Populus balsamifera subsp. trichocarpa
  misc_feature (1)..(127): Pfam Name: DUF640 Pfam Description: Protein of unknown function (DUF640)
  misc_feature: Ceres Annot ID no. 1482911
  misc_feature: Bit score of 378.4 for HMM based on sequences of Figure 10
  misc_feature: Functional Homolog Of SEQ ID NO. 209
MAPDQQNPPPLSRYESQKRRDWNTFGQYLRNQRPPVALSQCNANHVLEFLRYLDQFGKTKVHLQGCVFFGQPEPPGPCTCPLKQAWGSLDALIGRLRAAYEENGGLPETNPFASGAIRVYLREVRDSQAKARGIPYKKKKKKRNPMKANDESSSFHMQ

SEQ ID NO: 219 - DNA, 799 bp, Brassica napus
  misc_feature: Ceres Clone ID no. 1118987
  misc_feature: Encodes the peptide sequence at SEQ ID NO. 220
aaattctcgattcgcttatattctcaaaaccaacgctaaataaaaacactctcaaagaaaaacaaaaaaaaaaccctagttttgatggaatcgactgattcggggtcacaacaacatggaggtgacccaggtccgtcctccgtaacgccctcttcacctccggcgacgccgcctagcaggtacgagtcgcaaaaacgacgtgactggaacacgttcttgcagtacctcaagaaccacaagccgcctctcgcgttatcacgatgtagcggagcgcacgtgatcgagttcctcaagtacctagatcagttcggtaagaccaaagtccacgtggcgacctgcccttacttcggacatcagcagcctccctctccttgcgcttgtcctctcaagcaagcctggggatctctcgatgctctgatcggacggttgagagctgcgtacgaggagcacggtgggaggcctgattccaaccctttcgccgcacgtgcggtcaggatttacttgagagaagtcagagaaagtcaagccaaggcacgtgggattccatacgagaagaagaaacggaaacgggcaccaactgtcactaccgctagaattgacgttgctccgtcgagacaaagtgaaggaggtggtggttgtaacgacagtgatccgtctgtcgccgaagctgtaccgccttaaattaaattattatatcatattaattagttttcttgttatattaagcatggaactcacacctttcgtactataatgtattttatttttctatatgaactattaagagttttcttttgcc

SEQ ID NO: 220 - protein, 198 aa, Brassica napus
  misc_feature (13)..(146): Pfam Name: DUF640 Pfam Description: Protein of unknown function (DUF640)
  misc_feature: Ceres Clone ID no. 1118987
  misc_feature: Bit score of 367.1 for HMM based on sequences of Figure 10
  misc_feature: Functional Homolog Of SEQ ID NO. 209
MESTDSGSQQHGGDPGPSSVTPSSPPATPPSRYESQKRRDWNTFLQYLKNHKPPLALSRCSGAHVIEFLKYLDQFGKTKVHVATCPYFGHQQPPSPCACPLKQAWGSLDALIGRLRAAYEEHGGRPDSNPFAARAVRIYLREVRESQAKARGIPYEKKKRKRAPTVTTARIDVAPSRQSEGGGGCNDSDPSVAEAVPP

SEQ ID NO: 221 - DNA, 828 bp, Brassica napus
  misc_feature: Ceres Clone ID no. 1073674
  misc_feature: Encodes the peptide sequence at SEQ ID NO. 222
acactctttctctcaatttctctctcttttaaaacactaatcactaaaatcttgattcactatatcgtcaaaaccaacgctaaatcaattaaactctctcaaagaaaacaagacaaagccctacttttgatggattcagggtcacaacgaccggggcctgttagcgaaggcgatccgggtccgtccatcgtaaccccctcttcaccgcctgcgacgcctagcaggtacgagtcgcagaaacgacgtgactggaccacgttcttgcagtacctcaagaaccacaagccgcctctttccttgtcacggtgtagcggagcacatgccatcgagttcctcaagtacttagatcagttcggtaagaccaaagtccacgtggcggcatgtccttactttggccatcagcaacctccgtctccttgcgcttgtcctctcaagcaagcctgggggtctctcgatgccctgatcggacggttgagagcagcctacgaagagaacggtggacggcccgagtcgaacccgttcgcggcacgtgcggttaggatttacttgagggaagtcagagaaagtcaagccaaggcccgtgggagaccctacgagaaaaagaaacggaaacggccaacaactgttaccaccgtgagagttgacgttgcttcgtcgagacaaagtgaaggagatggttgtaacatcggtgatccgtcgtatgtggccgaggctgtacctccttaattaagttattattattgtcatgatatattaaatacattatatatgtctggaactcacatcaccttcttgagttaactattgaaaatatttttgttctagttc

SEQ ID NO: 222 - protein, 198 aa, Brassica napus
  misc_feature (14)..(146): Pfam Name: DUF640 Pfam Description: Protein of unknown function (DUF640)
  misc_feature: Ceres Clone ID no. 1073674
  misc_feature: Bit score of 353.3 for HMM based on sequences of Figure 10
  misc_feature: Functional Homolog Of SEQ ID NO. 209
MDSGSQRPGPVSEGDPGPSIVTPSSPPATPSRYESQKRRDWTTFLQYLKNHKPPLSLSRCSGAHAIEFLKYLDQFGKTKVHVAACPYFGHQQPPSPCACPLKQAWGSLDALIGRLRAAYEENGGRPESNPFAARAVRIYLREVRESQAKARGRPYEKKKRKRPTTVTTVRVDVASSRQSEGDGCNIGDPSYVAEAVPP

SEQ ID NO: 223 - DNA, 939 bp, Brassica napus
  misc_feature: Ceres Clone ID no. 1084747
  misc_feature: Encodes the peptide sequence at SEQ ID NO. 224
acactctttctctcattttctctctcttttaaaacactaatcactaaaatcttgattcactgtatcctcaaaaccaactctaaatcaaactctctcaaagaaaacaagccaaagccctactttggatggattcagggtcacaacgaccggggcctgtcagcgaaggcgatccgggtccgtccatcgtaaccccctcttcaccgcctgcggcgcctagcaggtacgagtcacagaaacgacgtgactggaccacgttcttacagtacctcaagaaccacaagccgcctctttccttgtcacggtgtagcggggcacatgccatcgagttcctcaagtacttagatcagttcggtaagaccaaagtccacgtggcggcgtgtccttacttcggccatcagcaacctccgtctccttgcgcttgtcctctcaagcaagcctgggggtctctcgatgccctgatcggacggctgagagcagcctatgaggagaacggtggacggcccgagtcgaacccgttcgcggcacgtgcggtcaggatttacttgagggaagtcagagaaagtcaagccaaggcccgtgggagaccctacgagaaaaagaaacggaaacggccaacaactgttaccaccgtgagagttgacgttgctccgtcgagacaaagtgaaggagatggttgtaacatcggtgatccgtcgtctctggccgaggctgtacctccttaattacgttattattattgtcatgatatattaaatacattatacatgtctggaactcacatcaccaaaaaaaaactcacatcaccttcttgagttaactatcgaaaatatatttttgttctagttcagttgatctttgatgaattacgttcttgaatttttcttttaattcttatgaattccacacatttttaaggactaattaacgaggttttcattc

SEQ ID NO: 224 - protein, 198 aa, Brassica napus
  misc_feature (14)..(146): Pfam Name: DUF640 Pfam Description: Protein of unknown function (DUF640)
  misc_feature: Ceres Clone ID no. 1084747
  misc_feature: Bit score of 353.0 for HMM based on sequences of Figure 10
  misc_feature: Functional Homolog Of SEQ ID NO. 209
MDSGSQRPGPVSEGDPGPSIVTPSSPPAAPSRYESQKRRDWTTFLQYLKNHKPPLSLSRCSGAHAIEFLKYLDQFGKTKVHVAACPYFGHQQPPSPCACPLKQAWGSLDALIGRLRAAYEENGGRPESNPFAARAVRIYLREVRESQAKARGRPYEKKKRKRPTTVTTVRVDVAPSRQSEGDGCNIGDPSSLAEAVPP

SEQ ID NO: 225 - DNA, 1036 bp, Glycine max
  misc_feature: Ceres Clone ID no. 536345
  misc_feature: Encodes the peptide sequence at SEQ ID NO. 226
ggtctatttgtctttctcttccttccccaccaaaatttccctttcacacttcacaaaaaagaaatactaaatgatttgtcagtagcagcaaacatgtccagcaagggaaaggagatagcagaaggatcatcaacaacaacaacagcaacaagatcctctcatggaggtgacgatcatcatcatcaccacaatcagcagcagcagcaacaacaacaacagttaccactgagtcgctatgagtctcagaagagaagggattggaacacttttggacagtacctgaggaaccaaaggcctccagtggcactttctcagtgcagctccaaccatgttcttgagttccttcgctacttggaccagtttgggaagaccaaagtgcactcacaagggtgcttgttctttgggcaaactgagccgccaggaccctgcacttgccctctcagacaagcttgggggagccttgatgcactcattggaagattgagagctgcatatgaagaaaatggaggccttcctgagaccaatccttttgcaagtggcaccataagagtctatcttagagaggtgagagattctcaggctaaggctagaggaatcccttataagaagaaaaagaagaagaggaatgttatcaggcccaacggagacacctcctcctcaaacttgcctatgcagtaataataattaaagaggagcatgtgatatctctaaattgtttcaaagtcgtgaatctgttgctaggccttggatataacttcagctgcaaacttggaattctggttataattgactatctggacatatccctgggtcaactttaacccttcggtggtctttatgtgtcaaggagtgtattttgttatttcgaatgagagtttagaatgaagttgacgaaaagtttaacattgggggtaagtccctgtattatatttacttatatatatttacactatcaagcatattatatagtcatgaaaataatgtgtatgatattgcatatggtattggtatcgtttgattaattctctgggaagct

SEQ ID NO: 226 - protein, 194 aa, Glycine max
  misc_feature (29)..(161): Pfam Name: DUF640 Pfam Description: Protein of unknown function (DUF640)
  misc_feature: Ceres Clone ID no. 536345
  misc_feature: Bit score of 370.0 for HMM based on sequences of Figure 10
  misc_feature: Functional Homolog Of SEQ ID NO. 209
MSSKGKEIAEGSSTTTTATRSSHGGDDHHHHHNQQQQQQQQQLPLSRYESQKRRDWNTFGQYLRNQRPPVALSQCSSNHVLEFLRYLDQFGKTKVHSQGCLFFGQTEPPGPCTCPLRQAWGSLDALIGRLRAAYEENGGLPETNPFASGTIRVYLREVRDSQAKARGIPYKKKKKKRNVIRPNGDTSSSNLPMQ

SEQ ID NO: 227 - DNA, 1127 bp, Glycine max
  misc_feature: Ceres Clone ID no. 1650005
  misc_feature: Encodes the peptide sequence at SEQ ID NO. 228
attccttctctcactcaccctcttatttcttcccaaaactccatatacatccatatctctatagccattaattcttctaccatagcacacagttaccaaaccaaaacatgtctactcaaattcaaaatggttcttcctcctcatcacaacaaccactgagtcgctatgagtcacaaaagcggcgagactggaacacctttggacagtacctgaggaatcagagtcccccagttccactctctcagtgcaacttcaaccatgtgttggatttccttcggtacctcgatcaatttgggaaaaccaaggtccacttgcacggttgcatcttctttggccagcccacccctcctgcaccctgtgcctgccctctcaggcaagcatggggtagcctcgatgccctcataggccggcttcgcgctgcctatgaggagcatggcggatcgccagagactaatccctttggaggaggagccattcgggtgtacctgcgtgaggtcaaggagtgtcaggcaaaggctagagggatcccatataagaagaagaagaagaagagaaacccaattctcaaggggactcaaagagctaaagatatcgagcaacaagcttcttgagatgatatatatctatatatatatatatatatatatgatatgaacgggccatatacgagcgagttaattggatatagcagatttggcactttgaaaaaagagcatctcagctgcttggaccaaaaattgttacagaaaatcagtgatatttcactaagtagttcagaacagaaaaatccttttaggcccatttactcgcagtaaatcttaaaatgcatgttagagatgtacaaccttgtaacttcttctaacatatgagacctctactccaaaatagaaacaacaagaatggctggctttacattcttgcagtagtttttccttatagtactttcaagcattatcaactacgcaaatatatctaggcattatattgaaagagttggaatttacattaatttggattaattagtacgttgtagtatgatgtcttaatcttgatgtgaacttcttggatttcaacttgatgcatatactgctgaaaatattcaatgtaaacttaattagcagagttgc

SEQ ID NO: 228 - protein, 167 aa, Glycine max
  misc_feature (1)..(133): Pfam Name: DUF640 Pfam Description: Protein of unknown function (DUF640)
  misc_feature: Ceres Clone ID no. 1650005
  misc_feature: Bit score of 358.8 for HMM based on sequences of Figure 10
  misc_feature: Functional Homolog Of SEQ ID NO. 209
MSTQIQNGSSSSSQQPLSRYESQKRRDWNTFGQYLRNQSPPVPLSQCNFNHVLDFLRYLDQFGKTKVHLHGCIFFGQPTPPAPCACPLRQAWGSLDALIGRLRAAYEEHGGSPETNPFGGGAIRVYLREVKECQAKARGIPYKKKKKKRNPILKGTQRAKDIEQQAS

SEQ ID NO: 229 - DNA, 618 bp, Solanum lycopersicum
  misc_feature: Ceres Annot ID no. 8453882
  misc_feature: Encodes the peptide sequence at SEQ ID NO. 230
atgtcaaatgatcaaataataatcgaaggcgaaggaggaggaggaggaggagaaggatcatcatcgagatccaaaaccactatacttatagcaccatctgacgatcatcatcatcatcatcagctaccaccagtaccacctcaactgagtagatatgagtctcagaaacgtcgcgattggaatacttttggacaatacttgaaaaatcaaaggccacctgttcctttatcccagtgtaactataaccacgtgctagagtttctccgatacctagatcaatttggaaaaactaaggtacatttacatggttgccctttttttggtcaaccagagcctccagggccttgtacttgtcctcttagacaagcatggggaagtcttgatgcacttattggtaggcttagagctgcctatgaagaaaatggtggcttacctgagaataatccattcgcgagtggagctatacgcgtttatcttagagaggtaagagattttcaagctaaagcaagaggaatttgttataagaagaagaagaagaagaggaaaatgcaaaacaaacctacttctagtaatgctcatgagccaactacaactacctttcaattccaatcttcttga

SEQ ID NO: 230 - protein, 205 aa, Solanum lycopersicum
  misc_feature (33)..(165): Pfam Name: DUF640 Pfam Description: Protein of unknown function (DUF640)
  misc_feature: Ceres Annot ID no. 8453882
  misc_feature: Bit score of 374.4 for HMM based on sequences of Figure 10
  misc_feature: Functional Homolog Of SEQ ID NO. 209
MSNDQIIIEGEGGGGGGEGSSSRSKTTILIAPSDDHHHHHQLPPVPPQLSRYESQKRRDWNTFGQYLKNQRPPVPLSQCNYNHVLEFLRYLDQFGKTKVHLHGCPFFGQPEPPGPCTCPLRQAWGSLDALIGRLRAAYEENGGLPENNPFASGAIRVYLREVRDFQAKARGICYKKKKKKRKMQNKPTSSNAHEPTTTTFQFQSS

SEQ ID NO: 231 - DNA, 639 bp, Oryza sativa
  misc_feature: Ceres Annot ID no. 1373087
  misc_feature: Encodes the peptide sequence at SEQ ID NO. 232
atggatccgtctggccccggtccgtcctctgcggcggctggcggcgcgccggccgtggcggcggcgccgcagccgccggcgcagctgagcaggtacgagtcgcagaagcggagggactggaacacgttcctgcagtacctgcggaaccaccggccgccgctgacgctggcgcggtgcagcggcgcgcacgtgatcgagttcctgaggtacctggaccagttcgggaagaccaaggtgcacgcgtcggggtgcgccttctacggccagcccagcccgccggggccgtgcccgtgcccgctgcgtcaggcgtggggatccctcgacgcgctcatcggccgcctccgcgccgcgtacgaggagagcggcggcacgcccgagtccaacccgttcgccgcgcgcgccgtccggatctacctccgcgaggtgcgggactcgcaggccaaggcgcgcggcatcccgtacgagaagaagaagcgcaagcgctcgcaggcggcgcagcccgccggcgtcgagccgtccggctcgtcttctgctgcagctgcagctgccggtggtggagacgcgggcagcggtggcggtgcagctgctactaccacagctcaacctggagggagtggcactgcaccaagcgcctcctga

SEQ ID NO: 232 - protein, 212 aa, Oryza sativa
  misc_feature (13)..(145): Pfam Name: DUF640 Pfam Description: Protein of unknown function (DUF640)
  misc_feature: Ceres Annot ID no. 1373087
  misc_feature: Bit score of 377.4 for HMM based on sequences of Figure 10
  misc_feature: Functional Homolog Of SEQ ID NO. 209
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDAGSGGGAAATTTAQPGGSGTAPSAS

SEQ ID NO: 233 - DNA, 648 bp, Sorghum bicolor
  misc_feature: Ceres Annot ID no. 8669372
  misc_feature: Encodes the peptide sequence at SEQ ID NO. 234
atggatccctccgggcctggcccgtcgtcggtcatgggggcagcaggcggcggcgaggcaccggccgtggcgccgccgcgtccggcgcagctgagcaggtacgagtcgcagaagcggagggactggaacacgttcctgcagtacctgcgaaaccaccggccgccgctgacgctggcgcggtgcagcggcgcgcacgtgatcgagttcctccggtacctggaccagttcggcaagaccaaggtgcacgccgccgggtgcgcctactacggccagccggcaccgccggggccctgcccgtgcccgctgcgccaggcgtggggctccctcgacgcgctcatcggccgcctgcgcgcggcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcagcagcaggccgccgccgccgcggatcctgcttcgacgagctcgtccgctgctgctgccggcgggagcgggactagcggcagggctgctgctgcagctgccgcgtccgccgctcaggccggagggagtagcgctgcaccgagcaccacttga

SEQ ID NO: 234 - protein, 215 aa, Sorghum bicolor
  misc_feature (15)..(147): Pfam Name: DUF640 Pfam Description: Protein of unknown function (DUF640)
  misc_feature: Ceres Annot ID no. 8669372
  misc_feature: Bit score of 377.8 for HMM based on sequences of Figure 10
  misc_feature: Functional Homolog Of SEQ ID NO. 209
MDPSGPGPSSVMGAAGGGEAPAVAPPRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQQQAAAAADPASTSSSAAAAGGSGTSGRAAAAAAASAAQAGGSSAAPSTT

SEQ ID NO: 235 - DNA, 1184 bp, Triticum aestivum
  misc_feature: Ceres Clone ID no. 1048839
  misc_feature: Encodes the peptide sequence at SEQ ID NO. 236
attctctctctctctctcgctgcctggccaggtagcttctctctctcctccacgctcctgccgacaaaaacaagaaacgacgtagcacggtagcagcaaagagaaagagagagagaccactggtagccaagggtgggagagaagcaggagtgccgctgccgatcgaccatggagccgggccccgacgcgcctcgcggcgagggagcgagcgcgccggaggagtctggaccgtcctcatcctcggtggccgtggagaaagctgaagagccacaggcacaagcgcagccgccggaaggaggaggccagcaagtcgcactgcaggagcacctgcagccgcagccgctgtcgcagcagccgccggtgccagcggggctgagccgctacgagtcgcagaagcgccgcgactggaacacgttcctgcagtacctgcgcaaccacaagccgccgctgacactcgcgcggtgcagcggcgcgcacgtcatcgagttcctcaagtacctggaccagttcggcaagaccaaggtgcacgccgacggctgcgcctacttcggccagcccaacccgccggctccgtgcgcgtgcccgctccgacaggcatggggcagcctcgacgcgctcattggccgcctgcgcgccgcctacgaggagtccggcggccgccctgagtccaaccccttcgccgcgcgcgccgtgcgcatctatctgcgcgaggtgcgcgaggcgcaggccaaggcgcgcgggataccctacgagaagaagaagcgcaagcgcggcagcacgtccgcccccgcggcgccgcctcccgttgtcaccgccgcggaggcggcagcgacctccggaggcggcgaggacgacgaggacgagccgtcacagtccgctgagcaacagcacacaacgccagcgtctcctccgactagaattagtagcgccggcgctactagtaccaccgcagcggcggcagccacaacgacgacgacgacaacgagagggaaggagaaggaagcggcagaaggatcagcgtgataagtgtagaccatcaaattacccttttgattattccatcgcatccaaattctaatctctgcaccatcataattttagttgtttgttattataattactgtgctgttatgatttgttggatatatatatatatataagagagaggtctaagtagttcgtac

SEQ ID NO: 236 - protein, 284 aa, Triticum aestivum
  misc_feature (51)..(185): Pfam Name: DUF640 Pfam Description: Protein of unknown function (DUF640)
  misc_feature: Ceres Clone ID no. 1048839
  misc_feature: Bit score of 373.6 for HMM based on sequences of Figure 10
  misc_feature: Functional Homolog Of SEQ ID NO. 209
MEPGPDAPRGEGASAPEESGPSSSSVAVEKAEEPQAQAQPPEGGGQQVALQEHLQPQPLSQQPPVPAGLSRYESQKRRDWNTFLQYLRNHKPPLTLARCSGAHVIEFLKYLDQFGKTKVHADGCAYFGQPNPPAPCACPLRQAWGSLDALIGRLRAAYEESGGRPESNPFAARAVRIYLREVREAQAKARGIPYEKKKRKRGSTSAPAAPPPVVTAAEAAATSGGGEDDEDEPSQSAEQQHTTPASPPTRISSAGATSTTAAAAATTTTTTTRGKEKEAAEGSA

SEQ ID NO: 237 - DNA, 1203 bp, Zea mays
  misc_feature: Ceres Clone ID no. 281322
  misc_feature: Encodes the peptide sequence at SEQ ID NO. 238
agcttgattctctctggctggtacgcggtagcctcgctctctctcctacctacacggctacacttaaacggcagcaggcacctgcaggcagggagagctgctaacggaccgatcggggagctgctggccatggagcctggtccggatgcgcccgctggtggtggtggcggaggaggaaccagtattagtgagccagcagaggccgggccgtcgccgtcgtcgtcctcggccgccgcagcagcctcgtcgtcgagccggcagcaggcagagcaggaagcacagcagcaacaaggagcacagcagagggaacagccagcagtaagggcccaggcgcagccgcagccgcagccgcatcagcagcagcctccggcggggctcagccggtacgagtcgcagaagcgccgggactggaacacgttcctgcagtacctgcggaaccacaagccgccgctgacgctggcacgctgcagcggcgcacacgtcatcgagttcctccgctacctggaccagttcggcaagacgaaggtgcacgctgagggctgcgcctacttcgggcagccgaacccgccggcgccctgcacgtgcccgctgcgccaggcctggggtagcctcgacgcgctcatcggccgcctccgcgccgcgtacgaggagtccggcggccgccccgagtccaacccgttcgcggccaaggccgtgcgcatctacctccgcgacgtgcgggaggcgcaggccaaggcccgcggcatcccgtacgagaagaagaagcggaagcgcgggagcgccgccgcgcctccggtcgcgccgcctcctgttgtgactgcagaggccgccgggacgtcgtcaggggccggcggtggtgatgacgaggacgacgacgaaccaccgccatctgcagatgaaccacgacgacagcagaccgccgcgccgactcctcctcctcctgcaagtatgatttccagcactagtgcaagcagtagcagtgtcgccccagtcacgacgacgacgacgacaagcaaggagaaagaaggatccgcgccaagctcgtgataagtttgtagatcatctactagccttctgattcaattctatcatcgccggcctccaaattataatcccaaccgcctccatcttaaatttttagttgctcactattactatatattgttattgtttactggcatatataagagagaggtctaaggg

SEQ ID NO: 238 - protein, 305 aa, Zea mays
  misc_feature (67)..(199): Pfam Name: DUF640 Pfam Description: Protein of unknown function (DUF640)
  misc_feature: Ceres Clone ID no. 281322
  misc_feature: Bit score of 372.9 for HMM based on sequences of Figure 10
  misc_feature: Functional Homolog Of SEQ ID NO. 209
MEPGPDAPAGGGGGGGTSISEPAEAGPSPSSSSAAAAASSSSRQQAEQEAQQQQGAQQREQPAVRAQAQPQPQPHQQQPPAGLSRYESQKRRDWNTFLQYLRNHKPPLTLARCSGAHVIEFLRYLDQFGKTKVHAEGCAYFGQPNPPAPCTCPLRQAWGSLDALIGRLRAAYEESGGRPESNPFAAKAVRIYLRDVREAQAKARGIPYEKKKRKRGSAAAPPVAPPPVVTAEAAGTSSGAGGGDDEDDDEPPPSADEPRRQQTAAPTPPPPASMISSTSASSSSVAPVTTTTTTSKEKEGSAPSS

SEQ ID NO: 239 - protein, 175 aa, Vitis vinifera
  misc_feature (11)..(143): Pfam Name: DUF640 Pfam Description: Protein of unknown function (DUF640)
  misc_feature: Public GI ID no. 147795605
  misc_feature: Bit score of 380.4 for HMM based on sequences of Figure 10
  misc_feature: Functional Homolog Of SEQ ID NO. 209
  misc_feature (175)..(175): Xaa is any aa, unknown, or other
MSNDRKRDSAEGSSRSTGEPQQQPQPLSRYESQKRRDWNTFGQYLKNQRPPVSLAQCSCNHVLEFLRYLDQFGKTKVHLHGCVFFGQPDPPAPCTCPLRQAWGSLDALIGRLRAAYEEHGGSPETNPFGNGAIRVYLREVRDCQSKARGIPYKKKKKKKNQIKPNNEAKSSKQSX

SEQ ID NO: 240 - DNA, 1062 bp, Panicum virgatum
  misc_feature: Ceres Clone ID no. 2004419
  misc_feature: Encodes the peptide sequence at SEQ ID NO. 241
actcatcgcgatcgatcgctgctagctagctcccagctgcgattctgatccttcgtgctccctcagttgtcgtcgtcgctggctcgctcgcttgcttgccagctctctctctcatagtagctagctgcttgcatggatccgtccgggcccggcccgtcgccggtcgttggcggaggaggcggcggtgacgcgccggccgtggtgccgcagcagcggccggcgcagctgagcaggtacgagtcgcagaagcggcgggactggaacacgttcctgcagtacctgcggaaccaccgcccgccgctgacgctggcgcggtgcagcggcgcgcacgtgatcgagttcctcaggtacctggaccagttcggcaagaccaaggtgcacgccgccgggtgcgcctactacggccagcccgcgccgccggggccctgcccgtgcccactgcggcaggcctggggctccctcgacgcgctcatcggccgcctgcgcgccgcgtacgaggagagcggcggcacgcccgagtccaaccccttcgccgcgcgcgccgtgcggatctacctccgcgaggtgcgcgactcgcaggccaaggcgcgcggcatcccctacgagaagaagaagcgcaagcgcgcgcagcaggccgccgagccgtcgtcgagctcgtccgccgccccggccggtgggagcgggagcatcagcagagctgctgcgacggccgccgctcatcaggctggagggagcagcgctgcaccgagcaacacctgagtacagtagatctgcagatcttgtttaattatcgtctccgcatcgcaagatttgagcttagctttctactgcttttgctatatatatgtgctttgcgttgcttcttttctctgcccatttcatccttttcttaccagggttttggatccccctttttttttttccggtttattaggtcaagtatatggctagatattggagtagtagtagctgaaaggggaagaagttggcgattaatcggtgcaagggcaactgtgtgttcatgatctgatacatatatattaatatatatatgttcttggt

SEQ ID NO: 241 - protein, 208 aa, Panicum virgatum
  misc_feature (16)..(148): Pfam Name: DUF640 Pfam Description: Protein of unknown function (DUF640)
  misc_feature: Ceres Clone ID no. 2004419
  misc_feature: Bit score of 380.3 for HMM based on sequences of Figure 10
  misc_feature: Functional Homolog Of SEQ ID NO. 209
MDPSGPGPSPVVGGGGGGDAPAVVPQQRPAQLSRYESQKRRDWNTFLQYLRNHRPPLTLARCSGAHVIEFLRYLDQFGKTKVHAAGCAYYGQPAPPGPCPCPLRQAWGSLDALIGRLRAAYEESGGTPESNPFAARAVRIYLREVRDSQAKARGIPYEKKKRKRAQQAAEPSSSSSAAPAGGSGSISRAAATAAAHQAGGSSAAPSNT

SEQ ID NO: 242 - protein, 212 aa, Oryza sativa subsp. indica
  misc_feature (13)..(145): Pfam Name: DUF640 Pfam Description: Protein of unknown function (DUF640)
  misc_feature: Public GI ID no. 125543059
  misc_feature: Bit score of 377.9 for HMM based on sequences of Figure 10
  misc_feature: Functional Homolog Of SEQ ID NO. 209
MDPSGPGPSSAAAGGAPAVAAAPQPPAQLSRYESQKRRDWNTFLQYLRNHRPPLTLARCSGAHVIEFLRYLDQFGKTKVHASGCAFYGQPSPPGPCPCPLRQAWGSLDALIGRLRAAYEESGGTPESNPFAARAVRIYLREVRDSQAKARGIPYEKKKRKRSQAAQPAGVEPSGSSSAAAAAAGGGDTGSGGGAAATTTAQPGGSGTAPSAS

SEQ ID NO: 243 - protein, 164 aa, Arabidopsis thaliana
  misc_feature (5)..(137): Pfam Name: DUF640 Pfam Description: Protein of unknown function (DUF640)
  misc_feature: Bit score of 285.6 for HMM based on sequences of Figure 10
  misc_feature: Locus ID NO. At1G16910
  misc_feature: Functional Homolog Of SEQ ID NO. 209
MTSTNTRNKGKCIVEGPPPTLSRYESQKSRDWNTFCQYLMTKMPPVHVWECESNHILDFLQSRDQFGKTKVHIQGCVFFGQKEPPGECNCPLKQAWGSLDALIGRLRAAYEENGGLTEKNPFARGGIRIFLREVRGSQAKARGVLYKKKKRLVVVGTGTSTTWT

SEQ ID NO: 244 - protein, 195 aa, Arabidopsis thaliana
  misc_feature (22)..(154): Pfam Name: DUF640 Pfam Description: Protein of unknown function (DUF640)
  misc_feature: Bit score of 323.0 for HMM based on sequences of Figure 10
  misc_feature: Locus ID NO. At1G78815
  misc_feature: Functional Homolog Of SEQ ID NO. 209
MASHSNKGKGIAEGSSQPQSQPQPQPHQPQSPPNPPALSRYESQKRRDWNTFCQYLRNQQPPVHISQCGSNHILDFLQYLDQFGKTKVHIHGCVFFGQVEPAGQCNCPLKQAWGSLDALIGRLRAAFEENGGLPERNPFAGGGIRVFLREVRDSQAKARGVPYKKRKKRKKRNPMKSHDGEDGTTGTSSSSNLAS

SEQ ID NO: 245 - protein, 219 aa, Arabidopsis thaliana
  misc_feature (36)..(168): Pfam Name: DUF640 Pfam Description: Protein of unknown function (DUF640)
  misc_feature: Bit score of 345.9 for HMM based on sequences of Figure 10
  misc_feature: Locus ID NO. At2G31160
  misc_feature: Functional Homolog Of SEQ ID NO. 209
MDMIPQLMEGSSAYGGVTNLNIISNNSSSVTGATGGEATQPLSSSSSPSANSSRYENQKRRDWNTFGQYLRNHRPPLSLSRCSGAHVLEFLRYLDQFGKTKVHTNICHFYGHPNPPAPCPCPLRQAWGSLDALIGRLRAAFEENGGKPETNPFGARAVRLYLREVRDMQSKARGVSYEKKKRKRPLPSSSTSSSSAVASHQQFQMLPGTSSTTQLKFEK

SEQ ID NO: 246 - protein, 177 aa, Arabidopsis thaliana
  misc_feature (7)..(139): Pfam Name: DUF640 Pfam Description: Protein of unknown function (DUF640)
  misc_feature: Bit score of 363.4 for HMM based on sequences of Figure 10
  misc_feature: Locus ID NO. At2G42610
  misc_feature: Functional Homolog Of SEQ ID NO. 209
MSSPRERGKSLMESSGSEPPVTPSRYESQKRRDWNTFGQYLKNQRPPVPMSHCSCNHVLDFLRYLDQFGKTKVHVPGCMFYGQPEPPAPCTCPLRQAWGSLDALIGRLRAAYEENGGPPETNPFASGAIRVYLREVRECQAKARGIPYKKKKKKKPTPEMGGGREDSSSSSSSFSFS

SEQ ID NO: 247 - protein, 201 aa, Arabidopsis thaliana
  misc_feature (15)..(147): Pfam Name: DUF640 Pfam Description: Protein of unknown function (DUF640)
  misc_feature: Bit score of 326.7 for HMM based on sequences of Figure 10
  misc_feature: Locus ID NO. At3G04510
  misc_feature: Functional Homolog Of SEQ ID NO. 209
MDLISQNHNNRNPNTSLSTQTPSSFSSPPSSSRYENQKRRDWNTFCQYLRNHHPPLSLASCSGAHVLDFLRYLDQFGKTKVHHQNCAFFGLPNPPAPCPCPLRQAWGSLDALIGRLRAAYEENGGAPETSPFGSRSVRIFLREVRDFQAKSRGVSYEKKRKRVNNKQITQSQPQSQPPLPQQPQQEQGQSMMANYHHGATQ

SEQ ID NO: 248 - protein, 195 aa, Arabidopsis thaliana
  misc_feature (30)..(162): Pfam Name: DUF640 Pfam Description: Protein of unknown function (DUF640)
  misc_feature: Bit score of 348.0 for HMM based on sequences of Figure 10
  misc_feature: Locus ID NO. At3G23290
  misc_feature: Functional Homolog Of SEQ ID NO. 209
MDHIIGFMGTTNMSHNTNLMIAAAATTTTTSSSSSSSSGGSGTNQLSRYENQKRRDWNTFGQYLRNHRPPLSLSRCSGAHVLEFLRYLDQFGKTKVHTHLCPFFGHPNPPAPCACPLRQAWGSLDALIGRLRAAFEENGGSPETNPFGARAVRLYLREVRDSQAKARGISYEKKKRKRPPPPLPPAQPAISSSPN

SEQ ID NO: 249 - protein, 190 aa, Arabidopsis thaliana
  misc_feature (7)..(139): Pfam Name: DUF640 Pfam Description: Protein of unknown function (DUF640)
  misc_feature: Bit score of 330.1 for HMM based on sequences of Figure 10
  misc_feature: Locus ID NO. At5G28490
  misc_feature: Functional Homolog Of SEQ ID NO. 209
MDLISHQPNKNPNSSTQLTPPSSSRYENQKRRDWNTFCQYLRNHRPPLSLPSCSGAHVLEFLRYLDQFGKTKVHHQNCAFFGLPNPPAPCPCPLRQAWGSLDALIGRLRAAYEENGGPPEANPFGSRAVRLFLREVRDFQAKARGVSYEKKRKRVNRQKPQTQPPLQLQQQQQQPQQGQSMMANYSGATV

SEQ ID NO: 250 - protein, 182 aa, Arabidopsis thaliana
  misc_feature (1)..(134): Pfam Name: DUF640 Pfam Description: Protein of unknown function (DUF640)
  misc_feature: Bit score of 338.4 for HMM based on sequences of Figure 10
  misc_feature: Locus ID NO. At5G58500
  misc_feature: Functional Homolog Of SEQ ID NO. 209
MEGETAAKAAASSSSSPSRYESQKRRDWNTFLQYLRNHKPPLNLSRCSGAHVLEFLKYLDQFGKTKVHATACPFFGQPNPPSQCTCPLKQAWGSLDALIGRLRAAFEEIGGGLPESNPFAAKAVRIYLKEVRQTQAKARGIPYDKKKRKRPHTDTATPIAGDGDDAEGSGGAALVVTAATTV

SEQ ID NO: 251 - protein, 196 aa, Arabidopsis thaliana
  misc_feature (13)..(145): Pfam Name: DUF640 Pfam Description: Protein of unknown function (DUF640)
  misc_feature: Bit score of 365.5 for HMM based on sequences of Figure 10
  misc_feature: Locus ID NO. At1G07090
  misc_feature: Functional Homolog Of SEQ ID NO. 209
MESADSGRSDPVKGDDPGPSFVSSPPATPSRYESQKRRDWNTFLQYLKNHKPPLALSRCSGAHVIEFLKYLDQFGKTKVHVAACPYFGHQQPPSPCSCPLKQAWGSLDALIGRLRAAYEENGGRPDSNPFAARAVRIYLREVRESQAKARGIPYEKKKRKRPPTVTTVRVDVASSRQSDGDPCNVGAPSVAEAVPP

SEQ ID NO: 252 - DNA, 449 bp, Arabidopsis thaliana
  misc_feature: Ceres Clone ID no. 1356785
  misc_feature: Encodes the peptide sequence at SEQ ID NO. 253
ggcatttttaagattcttttaattatatcagacagagagatatgacttttgtagttcgtcttcttgtgtgtctcttattgacgcttacaattacatcttctctagcccgcaaccctgtttccgtttcaggtgggtttgagaattctggattccaaaggagtttgttgatggtgaacgttgaggactacggtgacccatctgcaaatcctaagcacgaccccggcgttcctccgtcagcaaccggccaacgtgtcgtcggcagaggctgacgtaatgttttagttaacgcagaaggaaagaactcttcttgtttacattttcagtttgtctgagattaaatctcagttcatatagctttctctaatctgtctatatagatattttctcgtaatctccatacaacttcatttatttttttcttatggcaatgactttgtaccttattttcc

SEQ ID NO: 253 - protein, 75 aa, Arabidopsis thaliana [sequence omitted]

SEQ ID NO: 254 - DNA, 418 bp, Brassica napus
  misc_feature: Ceres Clone ID no. 951785
  misc_feature: Encodes the peptide sequence at SEQ ID NO. 255
ctgagtctctctgaccaaaggagagatgagttttgttgtacttcgtcttgctgtgtttcttctgttgacgcttacagttacatattcatcccctagttccgtttctgttccagttgttaagattggaatcgaaaggaggtcgttgatagtcaacgtcaaggattatgatggtccgtccgcaaacccaaaacacaatcccggcactcctccggttactaccagccaacgcagccccggcagagggtgacctacctctttaattaacccacaagggaagaagaaatgaatctctcagttttacatgttcagtttgtccgagatgaagtgaaatttctctgtttctacacctttctccaatatgtatattgatatcaatatgtgtcttagtcatttctcacacaatttcttataaataaag

SEQ ID NO: 255 - protein, 73 aa, Brassica napus
  misc_feature: Ceres Clone ID no. 951785
  misc_feature: Bit score of 188.0 for HMM based on sequences of Figure 6
  misc_feature: Functional Homolog Of SEQ ID NO. 253
MSFVVLRLAVFLLLTLTVTYSSPSSVSVPVVKIGIERRSLIVNVKDYDGPSANPKHNPGTPPVTTSQRSPGRG

SEQ ID NO: 256 - DNA, 228 bp, Populus balsamifera subsp. trichocarpa
  misc_feature: Ceres Annot ID no. 1440346
  misc_feature: Encodes the peptide sequence at SEQ ID NO. 257
atggcatttggagttcgcttgtgtttgtgtctcctgcttgtctttgctgtaacatcttcagctcgaaacaccatttcattctcagataacgaaatggccttggctataaaggggaggtccttgaagattacactgaacgattacggtgacccaatagcaaaccgtgggcacgatccttcacaaagaaacaagaattggggtggcagcggcggtggccgtaaaggctga

SEQ ID NO: 257 - protein, 75 aa, Populus balsamifera subsp. trichocarpa
  misc_feature: Ceres Annot ID no. 1440346
  misc_feature: Bit score of 203.3 for HMM based on sequences of Figure 6
  misc_feature: Functional Homolog Of SEQ ID NO. 253
MAFGVRLCLCLLLVFAVTSSARNTISFSDNEMALAIKGRSLKITLNDYGDPIANRGHDPSQRNKNWGGSGGGRKG

SEQ ID NO: 258 - DNA, 448 bp, Brassica napus
  misc_feature: Ceres Clone ID no. 1085177
  misc_feature: Encodes the peptide sequence at SEQ ID NO. 259
aaaccaaaatgagatgagttttggagttcgtcttcttttgtttctcatactaacccttccacttgttacatcctctggccgcaacactctttgtgtttcaggaattgggaagacaggggtagcaaaaagattattgatggtgagcatcgaggattatggtgatccatctgcaaacaccagacacgatcccagcgttccaaccaatgcaaaggctgacacaacaccttaaaagtcgttgattttacttgtgtactctatgtttttttttggggtaaaattgtgtactctatgttgaatatatatgtaataatatctgctttgagcgagttgtattacagtcatctgagtagaaaacacgcaaaatcttgtgaaaaccatgtaagatatgtatcaatccaacactttggggacaataaggcatggttttggtgtcaacataaaacatgac

SEQ ID NO: 259 - protein, 71 aa, Brassica napus
  misc_feature: Ceres Clone ID no. 1085177
  misc_feature: Bit score of 80.7 for HMM based on sequences of Figure 6
  misc_feature: Functional Homolog Of SEQ ID NO. 253
MSFGVRLLLFLILTLPLVTSSGRNTLCVSGIGKTGVAKRLLMVSIEDYGDPSANTRHDPSVPTNAKADTTP

SEQ ID NO: 260 - DNA, 400 bp, Arabidopsis thaliana
  misc_feature: Ceres Clone ID no. 157151
  misc_feature: Encodes the peptide sequence at SEQ ID NO. 261
aaactgcaattggataaccacaaccagaatcgattttgaatcatcatttctataaatatatacgactcatacatacatatacatacctcttaaacaaaactgagatgagttttggaactcgtcttcttttgtttctcatactaacacttccacttgtaacatcttcatccccaaacactcttcatgtttcaggaattgtgaagacagggactacaagtagattcttgatgatgaccatcgaggattatgacgatccatctgcaaacaccagacacgatcccagcgttccgaccaatgcaaaggctgacacaacaccttaaaactcttctgggtttacttgtttagtctatgttgaataaataaatatatatataataatctctctcttttgactgagctc

SEQ ID NO: 261 - protein, 71 aa, Arabidopsis thaliana
  misc_feature: Ceres Clone ID no. 157151
  misc_feature: Bit score of 67.1 for HMM based on sequences of Figure 6
  misc_feature: Functional Homolog Of SEQ ID NO. 253
MSFGTRLLLFLILTLPLVTSSSPNTLHVSGIVKTGTTSRFLMMTIEDYDDPSANTRHDPSVPTNAKADTTP

SEQ ID NO: 262 - DNA, 1191 bp, Arabidopsis thaliana
  misc_feature: Ceres Annot ID no. 544549
  misc_feature: Encodes the peptide sequence at SEQ ID NO. 263
atgtggctctctcatctcttcatgtccctctctaagctgacgtgtaatttctccattttctctgtctttatggcttgtggctctattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatgatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataa

SEQ ID NO: 263 - protein, 396 aa, Arabidopsis thaliana
  misc_feature (130)..(192): Pfam Name: zf-Dof Pfam Description: Dof domain, zinc finger
  misc_feature: Ceres Annot ID no. 544549
  misc_feature: Bit score of 808.2 for HMM based on sequences of Figure 2
MWLSHLFMSLSKLTCNFSIFSVFMACGSIGMSQVRDTPVKLFGWTITPVSHDPYSSSSHVLPDSSSSSSSSSLSLRPHMMNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 264 - protein, 385 aa, Vitis vinifera
  misc_feature (114)..(176): Pfam Name: zf-Dof Pfam Description: Dof domain, zinc finger
  misc_feature: Public GI ID no. 157355009
  misc_feature: Bit score of 840.4 for HMM based on sequences of Figure 2
  misc_feature: Functional Homolog Of SEQ ID NO. 263
MLDFKDPAIKLFGKTISLPLNPHLSPTSPPPPPLSSTTSFPDDTSQGLQPPSQDQEFEGKEEDGTSRQTSEELKDPTASPGVSENPETPSADKETSKDGEQSEISGSQEKTLKKPDKILPCPRCNSMDTKFCYYNNYNVNQPRHFCKNCQRYWTAGGTMRNVPVGAGRRKNKNSSASQYPLQTARASAANGIHHPALGNNGTVLNFGSDAEKGNIAGLEPVVKNFQAFSPHVPCFPGASWSYPWNPAQWSSKIPPPAFCPPGFPISFYPAPAYWGCTVPGSWNIPCIPPTSSSPIHSALATNHNSPTLGKHARDGETLRIDDPNEAAKSSIWTTLGIKNDGSNGGSLLKAFQSKGDEKKRIAEMSPVLQANPAALSRSLNFHERA

SEQ ID NO: 265 - DNA, 1491 bp, Populus balsamifera subsp. trichocarpa
  misc_feature: Ceres Annot ID no. 1464457
  misc_feature: Encodes the peptide sequence at SEQ ID NO. 266
atgtcggatttggcgatcaagttgtttgggaagacgattccactgcaagtcaatcagctggagggggatgtgtcttgtgctattaacaagcacgagtcttcctcaggaacaccagttgccccacccgagcctgaggagtactgttacactgctactacttgcttgcacgaaaaagacaaggaagagcaagaaggcaaccacagggagtcttcaggagaggaaattgccaacgagaaacaagaagatgttacctcgtgtcagatcaccgaggattcaaaagatccaacatcatcaggaattagtgagaatccaaagactccctcagttgagagggaaacttcatcactgaaaagcagtaaggatgaagaacaaagggagacaagcatctcacaagaaaagactctgaagaagcctgataaaatacttccatgccctcgatgtaatagcatggatactaaattctgttattacaacaattacaacgtcaatcagcctcgtcatttctgtaaaaagtgtcagagatactggactgctggaggaaccatgaggaatgtgcctgtgggagcaggacggcgcaagaataagagctcttcagcttcacattatcgtcacttaatggtatcagaagctctccgaacagttcaagtccatgccatgaatggagttcataacccctctttcggaaacaacaccactgtccttgcatttggttccgattctcctctttgtgattctgttgcctctgtgttgaatctttcagagaaaacgcaaaatagtgttcgaaatgagtatcacaggcctgaacatagaatctttgttccttgtggaggggcgggaagtaatggggatgatcgctcaagtggatctcccgccacagcttcggattcatcagagaagggatgtaatggtaattcgagagaagcagttaataaggattatcaatcctttcctccccaggttccctgcttccccgggcctccttggccatatcaatggaactctgcgctgcctccacctacgttttaccccccaggctttccagtatcgttttaccctgcaccaacttactggggttgtactgtcccgagcccttggaatgtaccgccatgtgtatcccctccatcaacctctctaaagcactgtaccctagactccagtcctacttctacactgggtaaacattcaagggatggcagcatccttcatccagcctacttaaaagagccctcgagggagggcaccaaatcagtaaaaggtgttttggttccgaagacatcgaggattgatgatcctagtgaagctgcaaagagctctatatgggcgaccctcgggatcatgagtgaaaaatccaattctattaatggaggaggtctctttaagggctttcaatcaaaaaacgaagacaaaaatgacatggctgggagaacttcagtgttgcaagcgaaccctgctgcattgtcccggtctctcaatttccatgagaacaattga

SEQ ID NO: 266 - protein, 496 aa, Populus balsamifera subsp. trichocarpa
  misc_feature (137)..(199): Pfam Name: zf-Dof Pfam Description: Dof domain, zinc finger
  misc_feature: Ceres Annot ID no. 1464457
  misc_feature: Bit score of 1090.1 for HMM based on sequences of Figure 2
  misc_feature: Functional Homolog Of SEQ ID NO. 263
MSDLAIKLFGKTIPLQVNQLEGDVSCAINKHESSSGTPVAPPEPEEYCYTATTCLHEKDKEEQEGNHRESSGEEIANEKQEDVTSCQITEDSKDPTSSGISENPKTPSVERETSSLKSSKDEEQRETSISQEKTLKKPDKILPCPRCNSMDTKFCYYNNYNVNQPRHFCKKCQRYWTAGGTMRNVPVGAGRRKNKSSSASHYRHLMVSEALRTVQVHAMNGVHNPSFGNNTTVLAFGSDSPLCDSVASVLNLSEKTQNSVRNEYHRPEHRIFVPCGGAGSNGDDRSSGSPATASDSSEKGCNGNSREAVNKDYQSFPPQVPCFPGPPWPYQWNSALPPPTFYPPGFPVSFYPAPTYWGCTVPSPWNVPPCVSPPSTSLKHCTLDSSPTSTLGKHSRDGSILHPAYLKEPSREGTKSVKGVLVPKTSRIDDPSEAAKSSIWATLGIMSEKSNSINGGGLFKGFQSKNEDKNDMAGRTSVLQANPAALSRSLNFHENN

SEQ ID NO: 267 - DNA, 1904 bp, Zea mays
  misc_feature: Ceres Clone ID no. 1584660
  misc_feature: Encodes the peptide sequence at SEQ ID NO. 268
tcccgatcgatccatccatcgatcgcccacgcttccgtccatccagactccagagagataaaatctaattcctggacctggagtgcagaccgatcgccgccaccgccgccgcgttgtttcttgtctgcgcagctgtggtgatggtgcggtaaaagaaggctgctcgatcactccaacaaaaaaaaaaggtcgagatcgcacgcggcaggcgacaagcagtttccaaagagaagggaagcctagaggaagggagctagagatgggggagggcagagcaggagacggcctcatcaagctgttcgggaagaccatccccgtgccggagacggccgccgtcggcgaggctgccaaggacatgcaacaaagcggcggcagcggcagcggtacgactgatccgaaagggcaagagaacaacgttcaggactccacaggctcgcctccgcagcaggaggtcgcggacaccgaagactcgtcggcagacaaacagcagggcgaggcgggcaacccaaaggagaagctcaagaagcccgacaagatcctgccgtgcccgcggtgcaacagcatggacaccaagttctgctactacaacaactacaacatcaaccagccgcgccacttctgcaagaactgccagaggtactggactgccggcggtgccatgcgcaacgtgcccgtgggcgcaggccggcgcaagagcaagagcgcgtcggccacttcccacttcctccagagggtcagggccggtctgcccgtcgacccgctcgtctgcgcggcagccaagactaacggcacggtgctcagcttcggctctgccatgtccagcttagacctcacggagcagatgaaacagctcaaggaaaagctcgtcccgatagcgggggacgagcgctcagttgggtctcgcactcaaggaccttctgccaaggcagaagacccggaccggaaggagaatgttacagcagataaatccgcgagagttgttcagcatccatgcatgacgaacggggtggccatgtggccatttagctgtgcgccaccagtaccggcctctgcctgttacggcccaggcagcatcgcaatcccgttctacccggcagcagctgctgctgctgcctactggggttgcatggttccaggagcttggagtggcgcatggccgcctcactccggccagtccgagacgggctcgtccattacctccgcctctccagcagcatccaccaagtccaacatctgcttcacgccaggaaagcaccctagagaccgcgacgaggaaggaggcgccaaaggaaatggcaaggtgtgggtgcccaagatgatccggatcgacgacgtggacgaggtggccaggagctctatcctgtcgctaatcgggatcggcggcgacaaggcaggcaaagatggcggcagaggctgcaagctcgcaagggtttttgagcagaacgaagaggcggcaaggacggcaactcctcactcggcagccatcagcggcttgccgttcttgcaggggaacccagctgcgctctcgcggtcactgaccttccaggaggggtcttgagcctctcgctcgattcacagctgagaattttgtacattagagggttgtatgtaatctaatctaggtggggggtggggctcatagctgccagcggacattgaaactatacaatagatagatatttgtagatagccaatatatatgggtcgggggaggaaaaaaaggataatgagagcaagtccccttatttgtatatattataatggattggaatatttggttgccaagtggtcttccagcaatagcgccagatgttctgatccactggctgttggcccatcgatttcagtggacaaaagtggtccaccttattctgggaaatttcagcatatattcagtttgtttc

SEQ ID NO: 268 - protein, 432 aa, Zea mays
  misc_feature (89)..(151): Pfam Name: zf-Dof Pfam Description: Dof domain, zinc finger
  misc_feature: Ceres Clone ID no. 1584660
  misc_feature: Bit score of 940.2 for HMM based on sequences of Figure 2
  misc_feature: Functional Homolog Of SEQ ID NO. 263
MGEGRAGDGLIKLFGKTIPVPETAAVGEAAKDMQQSGGSGSGTTDPKGQENNVQDSTGSPPQQEVADTEDSSADKQQGEAGNPKEKLKKPDKILPCPRCNSMDTKFCYYNNYNINQPRHFCKNCQRYWTAGGAMRNVPVGAGRRKSKSASATSHFLQRVRAGLPVDPLVCAAAKTNGTVLSFGSAMSSLDLTEQMKQLKEKLVPIAGDERSVGSRTQGPSAKAEDPDRKENVTADKSARVVQHPCMTNGVAMWPFSCAPPVPASACYGPGSIAIPFYPAAAAAAAYWGCMVPGAWSGAWPPHSGQSETGSSITSASPAASTKSNICFTPGKHPRDRDEEGGAKGNGKVWVPKMIRIDDVDEVARSSILSLIGIGGDKAGKDGGRGCKLARVFEQNEEAARTATPHSAAISGLPFLQGNPAALSRSLTFQEGS

SEQ ID NO: 269 - protein, 476 aa, Oryza sativa subsp. japonica
  misc_feature (103)..(165): Pfam Name: zf-Dof Pfam Description: Dof domain, zinc finger
  misc_feature: Public GI ID no. 115474149
  misc_feature: Bit score of 1037.6 for HMM based on sequences of Figure 2
  misc_feature: Functional Homolog Of SEQ ID NO. 263
MDDLAAASPPHPPPPPPESHVPPPPQTPEKDSCEDTGDMRISEEKPCTDQELDADQMNSSSFNSSSECENQTPSNDEMTGSESKSEAAQTEGGGSSEEKVLKKPDKILPCPRCNSMDTKFCYYNNYNINQPRHFCKSCQRYWTAGGSMRNLPVGAGRRKSKSSTANYRSILITGSNLAAPAGDAPLYQLSIKGDQTATAVKFAPDSPLCNSMASVLKIGEQSKNAKPTSTAQPRNGETQTCPASGTTSDSPRNEPVNGAVSGHQNGIVGHSGVPPMHPIPCFPGPPFVYPWSPAWNGIPAMAPPVCTAPAEPANSSDNGSTASVQWSMPPVMPVPGYFPVIPSSVWPFISPWPNGAWSSPWIQPNCSVSASSPTSTSTCSDNGSPVLGKHSRDSKPQGDDKAEKNLWIPKTLRIDDPDEAAKSSIWTTLGIEPGDRSMFRSFQSKPESREQISGAARVLQANPAALSRSQSFQETT

SEQ ID NO: 270 - DNA, 1560 bp, Sorghum bicolor
  misc_feature: Ceres Annot ID no. 8636233
  misc_feature: Encodes the peptide sequence at SEQ ID NO. 271
atggatgcgggcaccgctcgacagttggagacgatcaaggtgatgagtgtcgtagcggtgtcgagtgtacccctgtgtttggagaagttgagtgcgtacctcgacgagaaacgtgttgcggttggcaagcttggtgtcgatggtcagcagcagcaagcaaagccgggagcttgtgtttgtttggatcggagtgagaagaagatgatggcggagtgccaaggaggaggaggaggggatttcctcatcaagctcttcgggaagaccatccccgtgccggagtccggcgacgccaaggagaacccgcacccggactcctccgacccgtccccgcagccggaggtcgtggacgcagaggaccccaagagctcaccggagacgacacaccagaagcccggccagggcaacggcagcggcgacgctgccagccagagggagaagctgaagaagcccgacaaggtgctgccatgcccgcgctgcaacagcatggacaccaagttctgctacttcaacaactacaacgtcaaccagccgcgccacttctgcaagaactgccagcgctactggaccgccggcggcgccatgcgcaacgttcccgtcggggccggtcgccgcaagaacaagaacgccgtcgccgcctcgcacttcctccacagggtcggggcggcctgcggcggcggcggcgacacgctcaagacgaccaacggcacggtgctcagcttcggcggccatggtggcggctgcgtgcctcctggtcctgcatgcttggacctcgtcgagcagctcagccaccacctggcggccccggtgatcaggaacgccggcaacaacccgggtccttgcagcgaaggatcgagcaactgcagggacgacaacaagaccatcaacgacaggtcttgtgtagacgaagccgcagcagcaaacggagacgacggatcagtgcagcacccagcaagcatgaacaacggcggcgcaaccgtgtggccgccgccgtacagctgcgcgccatctccggcggcgtatttctcctcgggcatcgcgatcccgatatacccagccgcaccaggttactggggctgcatggttcccggagcttggagcctgccatggccggtgcaacagcccccgtcgtcgcagtcgcaggggccggcggcgggcctctcgtcgtcgacgtcgcccaccaccaccagtgctccttcggtctcatcatccggggcagccgactcccacacgctggggctgggcaagcacccccgggaccgggaggagggtgacgacgggagaaacgccaaggtgtgggctcccaagaccatccggatagacgacgtggacgaggtggccaggagctccatctggtcgctcatcgggatcaaaggcgacaaggcgaagcagcaggacgacgatgctgctggtgggcacaagcagaagcagcttgttgggatggtgttcgagcccaagcgcgaggccaccaagaagccggcggccatgatgacaagctcgccgctcctgcacgccaaccccgtcgcgctcacgcgctccgtggccttccaggagggctcttga

SEQ ID NO: 271 - protein, 519 aa, Sorghum bicolor
  misc_feature (149)..(211): Pfam Name: zf-Dof Pfam Description: Dof domain, zinc finger
  misc_feature: Ceres Annot ID no. 8636233
  misc_feature: Bit score of 999.7 for HMM based on sequences of Figure 2
  misc_feature: Functional Homolog Of SEQ ID NO. 263
MDAGTARQLETIKVMSVVAVSSVPLCLEKLSAYLDEKRVAVGKLGVDGQQQQAKPGACVCLDRSEKKMMAECQGGGGGDFLIKLFGKTIPVPESGDAKENPHPDSSDPSPQPEVVDAEDPKSSPETTHQKPGQGNGSGDAASQREKLKKPDKVLPCPRCNSMDTKFCYFNNYNVNQPRHFCKNCQRYWTAGGAMRNVPVGAGRRKNKNAVAASHFLHRVGAACGGGGDTLKTTNGTVLSFGGHGGGCVPPGPACLDLVEQLSHHLAAPVIRNAGNNPGPCSEGSSNCRDDNKTINDRSCVDEAAAANGDDGSVQHPASMNNGGATVWPPPYSCAPSPAAYFSSGIAIPIYPAAPGYWGCMVPGAWSLPWPVQQPPSSQSQGPAAGLSSSTSPTTTSAPSVSSSGAADSHTLGLGKHPRDREEGDDGRNAKVWAPKTIRIDDVDEVARSSIWSLIGIKGDKAKQQDDDAAGGHKQKQLVGMVFEPKREATKKPAAMMTSSPLLHANPVALTRSVAFQEGS

SEQ ID NO: 272 - DNA, 1567 bp, Panicum virgatum
  misc_feature: Ceres Clone ID no. 1777035
  misc_feature: Encodes the peptide sequence at SEQ ID NO. 273
agccacagcacagcacggcacggccggtctctccttcttcttcttcttccccggcgccagcggacctgcgggacctcgtcgtcgtcggccgatccttcactggcagggcagcagcgagctgcaattaacggcggcggcggaggatcggggaggaggacgacgaagatggtggtggagtccgcggggggcggcggaggggactgcctcatcaagctgttcgggaagaccatccccgtgccggaggccgccgccgacaaggagagcggcagcagcatcagctcctgcaccgaatccgacaccccggagaacgcctcggagccgtccccgcagccggaggtcatggacgccgaggaccccaagagctcgccggagacgcagccgccgcccggcgccggcgacttggccgggcagagggagaagctcaagaggcccgacaaggtgctgccgtgcccgcgctgcaacagcatggacaccaagttctgctacttcaacaactacaacgtcaaccagccgcgccacttctgcaagaactgccagcgctactggaccgccggcggtgccatgcgcaacgtgcccgtcggcgccggccgccgcaagaacaagcacgccgtcgccgcctcccacttcctgcacagggtccgggccgcgctgcccgccgccgccggcgacccgctcagggccaacgccacggtgctcagcttcggcggccacggccacggcgcgcctcccgcggcgctgcaggacctcgccgagcaggtgacccacctgaaggagaagctgctcgtcccggcaaggaacgccggcgacccatcgccggtgggtccgtgcagcgaaggaccaagcagcacggacgacaaggcccatggcggcggcatcaaggagaagcccgccgtagacaggcctgcaaacggagcgccgcagcttccggcaagcatgaacggagcaaccgtgtggccgtacggcggctgcgcgccatctccggcggcgtatttctcgtcgggcatcgcgattccgatatacccggccgcaccgggttactggggctgcatggttcccgcccccggaccttggagcctgccatggtcggtgcagggcctctcgttgcccaccagtgctccttcactcccgtcatcggggcctgaccccgacctcacgctgggcaagcaccccagggagggggacgaggggagaagcgcccatggtggtggcaaggtgtgggcgcccaagacgatccggatcgacgacgccgacgaggtggccaggagctcgatctggtccctcatcgggatcaaaggcgacaggaagcaggacgccgcggatcatcacggcgctgccgggcacaagcacgggacggtgttcgagcagaagcgggaggccaagaagcaaccggcgatgatcgcaagctcgccgctcctgcacaccaaccccgtcgcgctgacacgctcggtgaccttccaggagggatcttgaagcccatcgatcggcactactgaaatttttgtaaatcagagagaggattgtaatataggtattggggggaagaaggaaacagagtgagtgtatgtgt

SEQ ID NO: 273 - protein, 434 aa, Panicum virgatum
  misc_feature (88)..(150): Pfam Name: zf-Dof Pfam Description: Dof domain, zinc finger
  misc_feature: Ceres Clone ID no. 1777035
  misc_feature: Bit score of 965.1 for HMM based on sequences of Figure 2
  misc_feature: Functional Homolog Of SEQ ID NO. 263
MVVESAGGGGGDCLIKLFGKTIPVPEAAADKESGSSISSCTESDTPENASEPSPQPEVMDAEDPKSSPETQPPPGAGDLAGQREKLKRPDKVLPCPRCNSMDTKFCYFNNYNVNQPRHFCKNCQRYWTAGGAMRNVPVGAGRRKNKHAVAASHFLHRVRAALPAAAGDPLRANATVLSFGGHGHGAPPAALQDLAEQVTHLKEKLLVPARNAGDPSPVGPCSEGPSSTDDKAHGGGIKEKPAVDRPANGAPQLPASMNGATVWPYGGCAPSPAAYFSSGIAIPIYPAAPGYWGCMVPAPGPWSLPWSVQGLSLPTSAPSLPSSGPDPDLTLGKHPREGDEGRSAHGGGKVWAPKTIRIDDADEVARSSIWSLIGIKGDRKQDAADHHGAAGHKHGTVFEQKREAKKQPAMIASSPLLHTNPVALTRSVTFQEGS

SEQ ID NO: 274 - DNA, 1719 bp, Panicum virgatum
  misc_feature: Ceres Clone ID no. 1990929
  misc_feature: Encodes the peptide sequence at SEQ ID NO. 275
agccacagcacagcacggcacggccggtctctccttcttcttcttcttcttcttctcccccggcgccagcggacctgcgggacctcgtcgtcgtcggccgatccttcactggcagggcagcagcgagctgcaattaacggcggcggcggaggatcggggaggaggacgacgaagatggtggtggagtccgcggggggcggcggaggggactgcctcatcaagctgttcgggaagaccatccccgtgccggaggccgccgccgacaaggagagcggcagcagcatcagctcctgcaccgaatccgacaccccggagaacgcctcggagccgtccccgcagccggaggtcgtggacgccgaggaccccaagagctcgccggagacgcagccgccgcccggcgccggcgacttggccgggcagagggagaagctcaagaggcccgacaaggtgctgccgtgcccgcgctgcaacagcatggacaccaagttctgctacttcaacaactacaacgtcaaccagccgcgccacttctgcaagaactgccagcgctactggaccgccggcggcgccatgcgcaacgtgcccgtcggcgccggccgccgcaagaacaagcacgccgtcgccgcctcccacttcctgcacagggtccgggccgcgctgcccgccgccgccggcgacccgctcagggccaacgccacggtgctcagcttcggcggccacggccacggcgcgcctcccgcggcgctgcaggacctcgccgagcaggtgacccacctgaaggagaagctgctcgtcccggcaaggaacgccggcgacccatcgccggtgggtccgtgcagcgaaggaccaagcagcacggacgacaaggcccatggcggcggcatcaaggagaagcccgccgtagacaggcctgcaaacggagcgccgcagcttccggcaagcatgaacggagcaaccgtgtggccgtacggcggctgcgcgccatctccggcggcgtatttctcgtcgggcatcgcgattccgatatacccggccgcaccgggttactggggctgcatggttcccgcccccggaccttggagcctgccatggtcggtgcagggcctctcgttgcccaccagtgctccttcactctcgtcatcggggcctgaccccgacctcacgctgggcaagcaccccagggagggggacgaggggagaagcgcccatggtggtggcaaggtgtgggcgcccaagacgatccggatcgacgacgccgacgaggtggccaggagctcgatctggtccctcatcgggatcaaaggcgacaggaagcaggacgccgcggatcatcacggcgctgccgggcacaagcacgggacggtgttcgagcagaagcgggaggccaagaagcaaccggcgatgatcgcaagctcgccgctcctgcacaccaaccccgtcgcgctgacacgctcggtgaccttccaggagggatcttgaagcccatcgatcggcactactgaaatttttgtaaatcagagagaggattgtaatataggtattggggggaagaaggaaacagagtgagtgtatgtgtaacatagctacttgtggacttgtaataggtatagccgcatgtacatagaattagctatttgggttggagaaagaccaggagatcaatatggcccctggttgtagataatatataatatgaaggaggaatatattgcttgaagt

SEQ ID NO: 275 - protein, 434 aa, Panicum virgatum
  misc_feature (88)..(150): Pfam Name: zf-Dof Pfam Description: Dof domain, zinc finger
  misc_feature: Ceres Clone ID no. 1990929
  misc_feature: Bit score of 965.0 for HMM based on sequences of Figure 2
  misc_feature: Functional Homolog Of SEQ ID NO. 263
MVVESAGGGGGDCLIKLFGKTIPVPEAAADKESGSSISSCTESDTPENASEPSPQPEVVDAEDPKSSPETQPPPGAGDLAGQREKLKRPDKVLPCPRCNSMDTKFCYFNNYNVNQPRHFCKNCQRYWTAGGAMRNVPVGAGRRKNKHAVAASHFLHRVRAALPAAAGDPLRANATVLSFGGHGHGAPPAALQDLAEQVTHLKEKLLVPARNAGDPSPVGPCSEGPSSTDDKAHGGGIKEKPAVDRPANGAPQLPASMNGATVWPYGGCAPSPAAYFSSGIAIPIYPAAPGYWGCMVPAPGPWSLPWSVQGLSLPTSAPSLSSSGPDPDLTLGKHPREGDEGRSAHGGGKVWAPKTIRIDDADEVARSSIWSLIGIKGDRKQDAADHHGAAGHKHGTVFEQKREAKKQPAMIASSPLLHTNPVALTRSVTFQEGS

SEQ ID NO: 276 - protein, 432 aa, Zea mays
  misc_feature (89)..(151): Pfam Name: zf-Dof Pfam Description: Dof domain, zinc finger
  misc_feature: Public GI ID no. 194692166
  misc_feature: Bit score of 940.9 for HMM based on sequences of Figure 2
  misc_feature: Functional Homolog Of SEQ ID NO. 263
MGEGRAGDGLIKLFGKTIPVPETAAVGEAAKDMQQSGGSGSGTTDPKGQENNVQDSTGSPPQQEVADTEDSSADKQQGEAGNPKEKLKKPDKILPCPRCNSMDTKFCYYNNYNINQPRHFCKNCQRYWTAGGAMRNVPVGAGRRKSKSASATSHFLQRVRAGLPVDPLVCAAAKTNGTVLSFGSAMSSLDLTEQMKQLKEKLVPIAGDERSVGSRTQGPSAKAEDPDRKENVTADKSARVVQHPCMTNGVAMWPFSCAPPVPASACYGPGSIAIPFYPAAAAAAAYWGCMVPGAWSGAWPPHSGQSETGSSITSASPAASTKSNICFTPGKHPRDRDEEGGAKGNGKVWVPKTIRIDDVDEVARSSILSLIGIGGDKAGKDGGRGCKLARVFEQNEEAARTATPHSAAISGLPFLQGNPAALSRSLTFQEGS

SEQ ID NO: 277 - DNA, 1554 bp, Populus balsamifera subsp. trichocarpa
  misc_feature: Ceres Annot ID no. 1458507
  misc_feature: Encodes the peptide sequence at SEQ ID NO. 278
atgtcagatttggcgataaagctgtttggcaagacgattccactgcaagtcaatcagcaggaggatgtttcttgtgctgctaacaagtacgagtcctcctcaggaacgcctcccgagtccgaggactgttatgataatactgctactgcaacttcctcacaggaaaaccacaactctcataaggaacgaggagagcaagaagggaacaacaacagggggccacaagctctgtatcagtatttcactgttactttgcattttgaaacggagacttcaggagaggaaattgccaatgataaacaagaagatgttacctcgaatcagatcaacaaggactcaaaaggtccaacatcatcaggcattagtgagaacccaaagactccctcagctgagagggaaacttcatcactgaaaagcagcaagaatgaagaacaaagtgagacaagcatctcgcaagagaagactttgaagaagcctgacaaaatacttccatgccctcgatgtaatagcatggacactaaattctgttattacaacaattacaatgtcaatcagcctcgtcatttctgtaaaaactgtcagagatactggactgctggaggaaccatgaggaatgtgcctgtgggagctggaaggcgcaagaataagagctcttctgcttcacactatcgtcacttaatggtatcagaagctctccgaacagctcaagtccatgccatgaatggatttcataacccctctctgggaaacaacggcactgtccttacctttggttccgattctcctctttgtgaatctgttgcctctgtgttgaacctttcagagaaaacacaaaatagtgttcgaaacgggtatcatagacctgaacatagaatccttgtgtcttgtggagggacaggaggtgacggggatgatcactcaagtgtatcttccgccacggcttcaaattcatcagagaagggatgcaatggtacttcgcgagaagcggttaacaaggattatcaatcatttcctccccaggcaccctgcttcccggggcctccttggccatatccatggaactctgcgattactccacctacgttttgcccttcaggctttccagtatcgtttttccctgcaccagcttactggggttgtactgttccaagcccttggaatgtaccgccatgtgcatcctctccatcagccactctaaaccacagtacccaaagctccagtcctacttttccactggggaaacattcaagggatggcaacatccttaatccaccctgcttagaagagccctccagggacggcaccaaatcagaaacgggtgttttggttccaaagaccttgaggattgatgatcctagtgaagctgcaaagagctctatatgggcgaccctcgggatcacgaatgagaaatccagttctattaatggaggaggtctcttcaagggctttcagtcaaaaagcgaagacagaaattacatggcaggaacaacttcagtgttgcaagcgaaccctgctgcgttttcccggtctctcaatttccatgagaacacttga

SEQ ID NO: 278 - protein, 517 aa, Populus balsamifera subsp. trichocarpa
  misc_feature (158)..(220): Pfam Name: zf-Dof Pfam Description: Dof domain, zinc finger
  misc_feature: Ceres Annot ID no. 1458507
  misc_feature: Bit score of 885.6 for HMM based on sequences of Figure 2
  misc_feature: Functional Homolog Of SEQ ID NO. 263
MSDLAIKLFGKTIPLQVNQQEDVSCAANKYESSSGTPPESEDCYDNTATATSSQENHNSHKERGEQEGNNNRGPQALYQYFTVTLHFETETSGEEIANDKQEDVTSNQINKDSKGPTSSGISENPKTPSAERETSSLKSSKNEEQSETSISQEKTLKKPDKILPCPRCNSMDTKFCYYNNYNVNQPRHFCKNCQRYWTAGGTMRNVPVGAGRRKNKSSSASHYRHLMVSEALRTAQVHAMNGFHNPSLGNNGTVLTFGSDSPLCESVASVLNLSEKTQNSVRNGYHRPEHRILVSCGGTGGDGDDHSSVSSATASNSSEKGCNGTSREAVNKDYQSFPPQAPCFPGPPWPYPWNSAITPPTFCPSGFPVSFFPAPAYWGCTVPSPWNVPPCASSPSATLNHSTQSSSPTFPLGKHSRDGNILNPPCLEEPSRDGTKSETGVLVPKTLRIDDPSEAAKSSIWATLGITNEKSSSINGGGLFKGFQSKSEDRNYMAGTTSVLQANPAAFSRSLNFHENT

SEQ ID NO: 279 - protein, 475 aa, Vitis vinifera
  misc_feature (118)..(180): Pfam Name: zf-Dof Pfam Description: Dof domain, zinc finger
  misc_feature: Public GI ID no. 147780712
  misc_feature: Bit score of 829.6 for HMM based on sequences of Figure 2
  misc_feature: Functional Homolog Of SEQ ID NO. 263
METMLPLLVFLLSFVPLLIAYEKSANKLAFVARFYLLLQHKMAVKKHSGFLKHKPLEGQEFEGKEEDGTSRQTSEELKDPTASPGVSENPETPSADKETSKDGEQSEISGSQEKTLKKPDKILPCPRCNSMDTKFCYYNNYNVNQPRHFCKNCQRYWTAGGTMRNVPVGAGRRKNKNSSASQYRHIMVSEALQTARASAANGIHHPALGNNGTVLNFGSDGPLCESVASVLNLADKTQNCMQNGFHKSEQRIPASCGGGENGDDHSSITLTNSAEKGNIAGLEPVVKNFQAFPPHVPCFPGASWSYPWNPAQWSSKIPPPAFCPPGFPISFYPAPAYWGCTVPGSWNIPCIPPTSSSPIHSALATNHNSPTLGKHARDGEVLNPANPGKEDHQKENNPERGVWIPKTLRIDDPNEAAKSSIWTTLGIKNDGSNGGSLLKAFQSKGDEKKRIAEMSPVLQANPAALSRSLNFHERA

SEQ ID NO: 280 - DNA, 1275 bp, Sorghum bicolor
  misc_feature: Ceres Annot ID no. 8642924
  misc_feature: Encodes the peptide sequence at SEQ ID NO. 281
atgggggagggcagagcaggagacggcctcatcaagctgttcggcaagaccatccccgtgccggagacgcccgccgcgggcgacgctgccaaggacatccaacaaagcggcagcagcggcacgactgatctgaaggggcaagagaacacccttcaggattccacaggctcgcctccgcagcaggaggttgcggacactgaagactcgtcggctgccaagaactcctcggcagacaaacagcagggcgaggcggccaaccagaaggagaagctcaagaagcctgacaagatcctgccttgcccccggtgcaacagcatggacaccaagttctgctactataacaactacaacatcaaccagccacgccacttctgcaagaactgccagaggtactggactgctggcggtgccatgcgcaacgtccctgtgggtgcaggccggcgcaagagcaagagcgcgtcagctgcttcccacttccttcagagggtcagggccgctttgcccatggatcccctctgcactgcagccaagacgaatggcacggtgctcagcttcggctcagacatgtccagcttagacctcacagagcagatgaagcacctgaaggagaagctcatcccaatagcggggatcaagaacggcgatgaacgttcagttggctcttgcactgaaggacctgcgaaggcagaagactcaaaccaaaaggagaatgttacagcagagaaatctgcaaaacttgttcagcatccatgcatgaacggggtggccatgtggccatttagctgtgcaccaccacctgcctgttacaccccaggcagcatagcaattccgttctacccagcacctgctgcctactggggctgcatggttccaggagcttggaatgccccatggccgcctcagtccccgtccgagacaggttcgacccttagcactgcttcaccagcatccacgaagtccaattgcttcacaccaggaaagcgccctagagactgcaacgaggaaggagataccaaaggaaatggcaaggtgtgggtgccaaagacgatccgaatcgatgacgtggatgaggtggctaggagttctatcttgtcgctaatcgggatcaatggcgacaaggcaggcaaagatggcaaagggtgcaagcttgcaagggtttttgagcagaaagaagaggcaaggacggcaactcactcagtcatcaatggcttgccattcttgcaggggaacccagctgcgctctcacggtcattgaccttccaggagggatcttga

SEQ ID NO: 281 - protein, 424 aa, Sorghum bicolor
  misc_feature (93)..(155): Pfam Name: zf-Dof Pfam Description: Dof domain, zinc finger
  misc_feature: Ceres Annot ID no. 8642924
  misc_feature: Bit score of 807.1 for HMM based on sequences of Figure 2
  misc_feature: Functional Homolog Of SEQ ID NO. 263
MGEGRAGDGLIKLFGKTIPVPETPAAGDAAKDIQQSGSSGTTDLKGQENTLQDSTGSPPQQEVADTEDSSAAKNSSADKQQGEAANQKEKLKKPDKILPCPRCNSMDTKFCYYNNYNINQPRHFCKNCQRYWTAGGAMRNVPVGAGRRKSKSASAASHFLQRVRAALPMDPLCTAAKTNGTVLSFGSDMSSLDLTEQMKHLKEKLIPIAGIKNGDERSVGSCTEGPAKAEDSNQKENVTAEKSAKLVQHPCMNGVAMWPFSCAPPPACYTPGSIAIPFYPAPAAYWGCMVPGAWNAPWPPQSPSETGSTLSTASPASTKSNCFTPGKRPRDCNEEGDTKGNGKVWVPKTIRIDDVDEVARSSILSLIGINGDKAGKDGKGCKLARVFEQKEEARTATHSVINGLPFLQGNPAALSRSLTFQEGS

SEQ ID NO: 282 - protein, 440 aa, Oryza sativa subsp. japonica
  misc_feature (101)..(163): Pfam Name: zf-Dof Pfam Description: Dof domain, zinc finger
  misc_feature: Public GI ID no. 115451001
  misc_feature: Bit score of 740.4 for HMM based on sequences of Figure 2
  misc_feature: Functional Homolog Of SEQ ID NO. 263
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVGLCAEGLSKTEESNQTNLKEKVSADRSPNVAQHPCMNGGAMWPFGVAPPPAYYTSSIAIPFYPAAAAAVAAYWGCMVPGAWNAPWPPQSQSQSVSSSSAASPVSTMTNCFRLGKHPRDGDEELDSKGNGKVWVPKTVRIDDVDEVARSSIWSLIGIKGDKVGADHGRGCKLAKVFESKDEAKASTHTAISSLPFMQGNPAALTRSVTFQEGS

SEQ ID NO: 283 - protein, 366 aa, Arabidopsis thaliana
  misc_feature (100)..(162): Pfam Name: zf-Dof Pfam Description: Dof domain, zinc finger
  misc_feature: Bit score of 712.8 for HMM based on sequences of Figure 2
  misc_feature: Functional Homolog Of SEQ ID NO. 263
MSQVRDTPVKLFGWTITPVSHDPYSSSSHVLPDSSSSSSSSSLSLRPHMMNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 284 - DNA, 1965 bp, Zea mays
  misc_feature: Ceres Clone ID no. 1573856
  misc_feature: Encodes the peptide sequence at SEQ ID NO. 285
gagcagatatcatccgttcgtttgtttgcccttttttgccggcctcctcgtctcttccggttccggctacaagtgaagtgagctcggccgtctgttgcctagcgtgctgcttcgttcgtcgttggcttgcagcagcttgccgaagagaagaaagcagcaggccgggagctttctgtttgtttggatccgagtgagaagaagatggtggccgagtgccacggaggaggagcagcagcagcaggaggggacttcctcatcaagctcttcgggatgaccatccccgtgccggagtgcggcgacgccaaggatattcagcagagcaagagcaacaggtggaccgagcaggatcaggattcccatggcctggagaccgcgcccgcgcccgcgcacacggacacggacacggacacctccgacccgtccccgcagccggaggtcgtggacgccgaggaccccacggagacgcaacagaggcccggcaacggcgacggcgagggcgatgctgccggccagagggagaagctgaagaagcccgacaaggtgctgccgtgcccgcgctgcaacagcatggacaccaagttctgctacttcaacaactacaacgtcaaccagccgcgccacttctgcaagaactgccagcggtactggacggccggcggcgccatgcgcaacgtgcccgtgggggccggccgccgcaagaacaagaacgccgccgcctcgcacttcttccagagggtccgggcgaccaacgccacggtgctcagcttcgggggccatggtggcgcgcctcctgctgcccgcttggacctggacctcgccgagcagctgagccaccagctggccccggtcaggagcgccggcgacgcgggccgcccttgcagcgaaggatcgagcagcagggacggcaacggcagcaggtcttctgtagacgaagctgcagcaaacgcagacgacgggtcagtgcagcagcacccaggcccagcaagcatgaacagcagcggggcaaccgtgtggccgccgtacagctgcgccccagctccggcggcgtacttcccccagggcatcgcgattccgatctacccggccgcaccggcctactggggctgcatggttcccggagcttggagcctgccatggccggtgcagcacccgtcgtcgtcgtcgtcgccgtcgcccaccaccaccagtgctccttcagtcgtctcgtcatccggggcagctgacgactcatcatcccacgcgctgggcaagcgcccccgggaccgggagggtgacgacgggagaaacggcggcaacgccaaggtgtgggcgcccaagagcatccggatagacgacgtggacgaggtggccaggagctcaatctggtccctcgtcgggatcaaaggcgaccagacgaagcagcaggacgcagcagacgaccacgccggtgggcacagcaagcagctcgggacggtgttcgagcccaagcgcggcgaggccaccaagaaggctatgatgacaagctcgccgctccttcacgcgaaccccgttgcgctcacgcgctccgtggccttccaggaggggtcttgattcttcttcaaggacatccatcagcagcagcaggaatttcctcatgcaacgttccttctcatctgaacttctgaactgaacatgagctgatcagcctgacagtacgtactgaattttgtttttgtataaatcatcataggattgtaatatctatctatatgcttagtgggaaacttagctagcgtatgtgtaagtggacttgtaatataggcggcacgcaggatgtacatagaattaattagctatatgggtttgagaaagaccaggagatcaataagaggtccctgggtgtagataaataacattaggggaaggaatgtattgcttcaggtatttcactcttcagcaacttgttgtcaaagtccattctataacaaagtattctattttttgttc

SEQ ID NO: 285 - protein, 455 aa, Zea mays
  misc_feature (110)..(172): Pfam Name: zf-Dof Pfam Description: Dof domain, zinc finger
  misc_feature: Ceres Clone ID no. 1573856
  misc_feature: Bit score of 673.2 for HMM based on sequences of Figure 2
  misc_feature: Functional Homolog Of SEQ ID NO. 263
MVAECHGGGAAAAGGDFLIKLFGMTIPVPECGDAKDIQQSKSNRWTEQDQDSHGLETAPAPAHTDTDTDTSDPSPQPEVVDAEDPTETQQRPGNGDGEGDAAGQREKLKKPDKVLPCPRCNSMDTKFCYFNNYNVNQPRHFCKNCQRYWTAGGAMRNVPVGAGRRKNKNAAASHFFQRVRATNATVLSFGGHGGAPPAARLDLDLAEQLSHQLAPVRSAGDAGRPCSEGSSSRDGNGSRSSVDEAAANADDGSVQQHPGPASMNSSGATVWPPYSCAPAPAAYFPQGIAIPIYPAAPAYWGCMVPGAWSLPWPVQHPSSSSSPSPTTTSAPSVVSSSGAADDSSSHALGKRPRDREGDDGRNGGNAKVWAPKSIRIDDVDEVARSSIWSLVGIKGDQTKQQDAADDHAGGHSKQLGTVFEPKRGEATKKAMMTSSPLLHANPVALTRSVAFQEGS

SEQ ID NO: 286 - DNA, 1521 bp, Populus balsamifera subsp. trichocarpa
  misc_feature: Ceres Annot ID no. 1476818
  misc_feature: Encodes the peptide sequence at SEQ ID NO. 287
atgtcggagccaaaagaccaggcatttaagctgttcgggaagactattcaagtgccagagatctctgttactactgctaccaccacagatgatgatgatgacgacgatagtcaagatcaagaccgtccttcttgtgcaaactcttctcttgatgagaccaatattactgacgattataataacaatgataaaagagatcatggagaagaagatacagaaactgatgataaggattcggtgggtaaaacaacaattgagaaccaggaagatggagcttcacctgtagctgccaaagagtcttcaaatctagatgcaacttcagggacaagtgaaaaccctaaaacaccttccgttgagaaagagagcacggcgttgaaaacttcaaacactgaagaagaacagagtgatacaagtaattcacaagagaaaaccctgaagaaaccagacaagatcattccatgcccccgctgtaatagcatggacacaaagttttgttactacaacaattacaacgtgaaccaaccccgacacttctgcaagaattgtcagagatattggacagctggcggtaccatgaggaatgtgcctgtgggtgctggtcgtcgcaaaaacaagaactcagcttctcattaccgtcacataaccattcctgaagctcttcagaatggtcgagctgatgttccaaatggagtccaccatccttcactgaaaactaatggaacagtgctaacctttggttctgatgcacctcttcatgaatcaatggcttcggtattgaatcttgctgataaaacaatgcggaactgcacaatgaatgggtttcataaacctgaagcattaagggtcccagtttcttatggaggtggtgaaaacggtgatgaccattctaatggatcttctgtcactgtgtcaaattcaagcgatgaagctggcaaaagtgtgtcaaaagaatcagctatgcagaattatcagggctacccccctcagataccatgttttcctggagttccctggccttacccttggaattcagctcaatggagctccccagtacccccacctgccttttgcccttccagttttcctatgccattctatcctgcagcagcttattggggttgtactgtaccaggtgcttggaatgtcccttggcttcctcaaccatcttctccaaaacaaacctcctcgagctctgaccctaactctccaaccctagggaaacattcaagagatgaaaacttgctcaaacctagcaactccaaagaagagctggtgaacactgaaagatgcctttggattccgaaaacgctgaggattgatgacccaggagaagccgcaaaaagctctatatggacaacacttgggattaagaatgataagcctggctcatttggtggccgaggactctttaaggcctttgattcaaaggttgagaagaatcgcgcagccgaaacctctccagtcttgcacgctaatcctgcagcattgtctagatctctcaaatttcaggagagctcataa

SEQ ID NO: 287 - protein, 506 aa, Populus balsamifera subsp. trichocarpa
  misc_feature (147)..(209): Pfam Name: zf-Dof Pfam Description: Dof domain, zinc finger
  misc_feature: Ceres Annot ID no. 1476818
  misc_feature: Bit score of 666.9 for HMM based on sequences of Figure 2
  misc_feature: Functional Homolog Of SEQ ID NO. 263
MSEPKDQAFKLFGKTIQVPEISVTTATTTDDDDDDDSQDQDRPSCANSSLDETNITDDYNNNDKRDHGEEDTETDDKDSVGKTTIENQEDGASPVAAKESSNLDATSGTSENPKTPSVEKESTALKTSNTEEEQSDTSNSQEKTLKKPDKIIPCPRCNSMDTKFCYYNNYNVNQPRHFCKNCQRYWTAGGTMRNVPVGAGRRKNKNSASHYRHITIPEALQNGRADVPNGVHHPSLKTNGTVLTFGSDAPLHESMASVLNLADKTMRNCTMNGFHKPEALRVPVSYGGGENGDDHSNGSSVTVSNSSDEAGKSVSKESAMQNYQGYPPQIPCFPGVPWPYPWNSAQWSSPVPPPAFCPSSFPMPFYPAAAYWGCTVPGAWNVPWLPQPSSPKQTSSSSDPNSPTLGKHSRDENLLKPSNSKEELVNTERCLWIPKTLRIDDPGEAAKSSIWTTLGIKNDKPGSFGGRGLFKAFDSKVEKNRAAETSPVLHANPAALSRSLKFQESS

SEQ ID NO: 288 - DNA, 1512 bp, Populus balsamifera subsp. trichocarpa
  misc_feature: Ceres Annot ID no. 1450024
  misc_feature: Encodes the peptide sequence at SEQ ID NO. 289
atgttggagccaaaagacccggctattaagctgtttgggaagactattcaagtgacagagatctcttctactaccactacagataatgatgatagtcaagatcaagaccgtccatcttgtgcaagctcttctctttatgacgccgattctgataataataagagatatcatggagaagaagatatagaagctgatgataaggactcggtggaaaaaagcctgactgagaaacaggaagatggagtttcacccgtggctactgaagagccttcaaatccagatgcaacctcagggacaagtgaaaaccctaaaacaccttccattgagaaggagagtgaaggattgcaaacttcaaggacagaagaagaagatagtgatacaagtaattcgccagaaaagaccctgaaaaaacctgataagatccttccatgcccccgctgtaatagcatggacaccaagttctgttactacaacaattacaacgtgaaccaaccccgacacttctgcaagaattgtcagagatattggacagctgggggaaccatgaggaatgtgcctgtgggtgctggtcgtcgcaaaaacaagaactcagcttctcattatcgtcacataaccattcctgaagctcttcagaatgttcgagctgatgttccaaatggagtctaccatccttcaatgaaaactaatggaacagtgctaacctttggctctgacacacctcttcatgaatcaatggcttctgtattgaaccttgcagataaaacaacgcggaattgcacaagaaacgggtctcataaacctgatgcagtgaggattccagtttcttatggaagtggagaaaacggtgatgaccattctaatggatcttcagtcacagtgtcaaattcaattgatgaggcaggcaaaagcatgtcgaaagaatcagctatgcagaattgtcagggctttccccctgagataccatgttttcctggagttccctggccttacccttggaattcagctcaatggagctccccattacccccacctgccttttgccctcccggttttcctatgccattctatcctgcagcagcatactggggttgcaccgtaccaggtgcttggaatatcccttggcttcctcagccatcttctcccaagcaaacctcctcgagctctggcccaaactctccaaccctagggaaacattcaagggatgaaaacatgctcaaatctagcaactctgaagaaggggagtcggcaaaagaaaataacactgaaagatgcctttggatcccaaaaacgctcaggattgttgacccaggtgaagctgcaaaaagctctatatggacgactctggggattaagaatgataagcctgacttgattggtgggcgaggactgtttaaggcgtttgattcaaaggtcgaaaagaatcatgaagccgaaacctctccagtcttacaagctaatcctgcagcattgtctagatcactcaaatttcaggagagctcgtattttgggtag

SEQ ID NO: 289 - protein, 503 aa, Populus balsamifera subsp. trichocarpa
  misc_feature (137)..(199): Pfam Name: zf-Dof Pfam Description: Dof domain, zinc finger
  misc_feature: Ceres Annot ID no. 1450024
  misc_feature: Bit score of 646.8 for HMM based on sequences of Figure 2
  misc_feature: Functional Homolog Of SEQ ID NO. 263
MLEPKDPAIKLFGKTIQVTEISSTTTTDNDDSQDQDRPSCASSSLYDADSDNNKRYHGEEDIEADDKDSVEKSLTEKQEDGVSPVATEEPSNPDATSGTSENPKTPSIEKESEGLQTSRTEEEDSDTSNSPEKTLKKPDKILPCPRCNSMDTKFCYYNNYNVNQPRHFCKNCQRYWTAGGTMRNVPVGAGRRKNKNSASHYRHITIPEALQNVRADVPNGVYHPSMKTNGTVLTFGSDTPLHESMASVLNLADKTTRNCTRNGSHKPDAVRIPVSYGSGENGDDHSNGSSVTVSNSIDEAGKSMSKESAMQNCQGFPPEIPCFPGVPWPYPWNSAQWSSPLPPPAFCPPGFPMPFYPAAAYWGCTVPGAWNIPWLPQPSSPKQTSSSSGPNSPTLGKHSRDENMLKSSNSEEGESAKENNTERCLWIPKTLRIVDPGEAAKSSIWTTLGIKNDKPDLIGGRGLFKAFDSKVEKNHEAETSPVLQANPAALSRSLKFQESSYFG

SEQ ID NO: 290 - DNA, 1362 bp, Populus balsamifera subsp. trichocarpa
  misc_feature: Ceres Annot ID no. 1503065
  misc_feature: Encodes the peptide sequence at SEQ ID NO. 291
atgttggagccaaaagacccggctattaagctgtttgggaagactattcaagactcggtggaaaaaagcctgactgagaaacaggaagatggagtttcacccgtggctactgaagagccttcaaatccagatgcaacctcagggacaagtgaaaaccctaaaacaccttccattgagaaggagagtgaaggattgcaaacttcaaggacagaagaagaagatagtgatacaagtaattcgccagaaaagaccctgaaaaaacctgataagatccttccatgcccccgctgtaatagcatggacaccaagttctgttactacaacaattacaacgtgaaccaaccccgacacttctgcaagaattgtcagagatattggacagctgggggaaccatgaggaatgtgcctgtgggtgctggtcgtcgcaaaaacaagaactcagcttctcattatcgtcacataaccattcctgaagctcttcagaatgttcgagctgatgttccaaatggagtctaccatccttcaatgaaaactaatggaacagtgctaacctttggctctgacacacctcttcatgaatcaatggcttctgtattgaaccttgcagataaaacaacgcggaattgcacaagaaacgggtctcataaacctgatgcagtgaggattccagtttcttatggaagtggagaaaacggtgatgaccattctaatggatcttcagtcacagtgtcaaattcaattgatgaggcaggcaaaagcatgtcgaaagaatcagctatgcagaattgtcagggctttccccctgagataccatgttttcctggagttccctggccttacccttggaattcagctcaatggagctccccattacccccacctgccttttgccctcccggttttcctatgccattctatcctgcagcagcatactggggttgcaccgtaccaggtgcttggaatatcccttggcttcctcagccatcttctcccaagcaaacctcctcgagctctggcccaaactctccaaccctagggaaacattcaagggatgaaaacatgctcaaatctagcaactctgaagaaggggagtcggcaaaagaaaataacactgaaagatgcctttggatcccaaaaacgctcaggattgttgacccaggtgaagctgcaaaaagctctatatggacgactctggggattaagaatgataagcctgacttgattggtgggcgaggactgtttaaggcgtttgattcaaaggtcgaaaagaatcatgaagccgaaacctctccagtcttacaagctaatcctgcagcattgtctagatcactcaaatttcaggagagctcgtattttgggtag

SEQ ID NO: 291 - protein, 453 aa, Populus balsamifera subsp. trichocarpa
  misc_feature (87)..(149): Pfam Name: zf-Dof Pfam Description: Dof domain, zinc finger
  misc_feature: Ceres Annot ID no. 1503065
  misc_feature: Bit score of 644.5 for HMM based on sequences of Figure 2
  misc_feature: Functional Homolog Of SEQ ID NO. 263
MLEPKDPAIKLFGKTIQDSVEKSLTEKQEDGVSPVATEEPSNPDATSGTSENPKTPSIEKESEGLQTSRTEEEDSDTSNSPEKTLKKPDKILPCPRCNSMDTKFCYYNNYNVNQPRHFCKNCQRYWTAGGTMRNVPVGAGRRKNKNSASHYRHITIPEALQNVRADVPNGVYHPSMKTNGTVLTFGSDTPLHESMASVLNLADKTTRNCTRNGSHKPDAVRIPVSYGSGENGDDHSNGSSVTVSNSIDEAGKSMSKESAMQNCQGFPPEIPCFPGVPWPYPWNSAQWSSPLPPPAFCPPGFPMPFYPAAAYWGCTVPGAWNIPWLPQPSSPKQTSSSSGPNSPTLGKHSRDENMLKSSNSEEGESAKENNTERCLWIPKTLRIVDPGEAAKSSIWTTLGIKNDKPDLIGGRGLFKAFDSKVEKNHEAETSPVLQANPAALSRSLKFQESSYFG

SEQ ID NO: 292 - protein, 473 aa, Vitis vinifera
  misc_feature (116)..(178): Pfam Name: zf-Dof Pfam Description: Dof domain, zinc finger
  misc_feature: Public GI ID no. 147866358
  misc_feature: Bit score of 590.0 for HMM based on sequences of Figure 2
  misc_feature: Functional Homolog Of SEQ ID NO. 263
  misc_feature (423)..(423): Xaa is any aa, unknown, or other
MQEPKDPAFKLFGKTIPMLADGDAPVSSGDVGDSGAAVAREDGLEEETEKDALGGKPAETKGEDGSEESRNSETVAESNENPKTPSIAEENVTLKTSKAEKGQSDSPDSQEKTLKKPDKILPCPRCNSMDTKFCYYNNYNINQPRHFCKSCQRYWTAGGTMRNVPVGAGRRKNKNSASHYRHITISEALQTVQIEATNGVHQPTLKSNGTVLTFGSDAPFCDSMTSVLNLEEKKMPNGARNGFHTHKEQGIPVSFRVQENGDDHSSASSITVSNSSEEGSKYGLHEAKRNSHGVPSRIPCIPGIPWPYPWNSAVPPPFCPPGFPMPFYPAAYWNCHVTAPWNIPWLSPPSSSANQKTPNSRQNSPTLGKHSREGDILKPSIVEDEETPKQRSSERCLWVPKTLRIDDPAEAAKSSIWTTLGIXNDKVDSVSGGGLFNAFHLKGDDKNHAMDTSAVLRANPAALSRSLNFQESS

SEQ ID NO: 293 - DNA, 2046 bp, Zea mays
  misc_feature: Ceres Clone ID no. 230073
  misc_feature: Encodes the peptide sequence at SEQ ID NO. 294
gcgtcgccaactccacttgtcagatcttgcccgtatggtatggagctcgccggagcagcctcccctcacccgccgccggaatcccacgtggcgccgccccgcccacctccgcagccgccggaagaggatttatgtgaagatagaggggacatgagagtcaccggcgaaaagccatgcacacatcgggaatcagatgttggtcagacaaatagttgtagccttaacaattccagtgagtgtgagaatcatacacccagcaacgacgaaatatcggaaccagagtccaatttggagatggccaagactgatcagggcggcgatgtgccgagcggagagaaggtcctgaagaagccagacaagatcctgccgtgccctcgctgcaacagcatggacacgaagttctgctactacaacaactacaacatcaagcagccaaggcatttctgcaagagctgtcagaggtactggaccgcaggcggaagcatgagaaacatccccgttggtgctgggaggcgcaagagcaagagctccagcgcgagttgccgcagcgtgttgattcccgttccaggcagcagtagtgtagctaatcctggcggagaggcttccctgtttccgttgtccgtaaaagcaaaccaagcagcagttagcttcgggcctgattcccccctctgcacctccatggcctccgtgctgaagatcggaggaggaggagagcaggttaagagctgcagccctgcctcagcagcagcacagcccaggaacggagaaacccagacccagacgtgcgcaccttcttctgctgctacaacaccatcagatggtccagggaatggattgcagaaaggagcagagagcgcacaccaaaaccaaaaccaaaaccaaaacggaatcattgggcacagcaacggagtcactccagtgcatcctataccgttcttccccggaccgcctttcgtgtacccctggagtccagcatggaacggcattcccgccatggcagcggcggtgtgcgcagccccagcgacagccgaagcagcgatttcatcagaacacggcaccgcgagcagcaccgtccagtggaacgtgccaccagcgatcgtgcccgtgctgccaccgggattctgcggcccgatcccagtcccggtaatcccgccgccttccgtctggccactgatcactccctggcccaacgcagcatggagcgcgccgtggctcgggcctagcgctagcgtgccgccggggtcatctcggagcagcggcagcagcacgtgctccgacagcggctgcggctccggctcccccgtcctgggaaagcactcgagggagtcgaggccgcagggcgacgagaaggcggaacgacggtgcctgtggatccccaagacgctccggatcgacgaccctgtcgaggccgccaagagctcgatctggacgacgctcgggatcgagcctggcgaccggggcatgttcaggccgttccagtcgaagcatggacggcagcaggagctgcaagcgtccggcgccgctcgcgccctgcaggccaacccggcggctctgtcgcgctcgcagtcttttcaggagacgacgtgattactacactacagaccagagcgttgctgaaacctgtgtggcattactattcagagacgattgtatttcaacttcaaggggggaaatgagagagagagcgcgagagagagattggcctgtttggttcactacctcagttgccacactttgcctaacttttctgactaaggttagttattcaattcgaacgactaacattaggcaaagtgtggcatatttagtcataaaccaaacatgccatatatgttctgtacaatatgattggcaacataggtgctgctgctgtacaaggcagcggacaccgttactgtaactgtaaccattggaagagtgcatcctcaaacagtgtgttgtttccatgtagagcgtgcccccaacatgttgggttggaggtgatcaggtttccagcgcgtgcgtgcttggttgtacaagaataactgtcaatagcttcccttcgcc

SEQ ID NO: 294 - protein, 515 aa, Zea mays
  misc_feature (104)..(166): Pfam Name: zf-Dof Pfam Description: Dof domain, zinc finger
  misc_feature: Ceres Clone ID no. 230073
  misc_feature: Bit score of 577.1 for HMM based on sequences of Figure 2
  misc_feature: Functional Homolog Of SEQ ID NO. 263
MELAGAASPHPPPESHVAPPRPPPQPPEEDLCEDRGDMRVTGEKPCTHRESDVGQTNSCSLNNSSECENHTPSNDEISEPESNLEMAKTDQGGDVPSGEKVLKKPDKILPCPRCNSMDTKFCYYNNYNIKQPRHFCKSCQRYWTAGGSMRNIPVGAGRRKSKSSSASCRSVLIPVPGSSSVANPGGEASLFPLSVKANQAAVSFGPDSPLCTSMASVLKIGGGGEQVKSCSPASAAAQPRNGETQTQTCAPSSAATTPSDGPGNGLQKGAESAHQNQNQNQNGIIGHSNGVTPVHPIPFFPGPPFVYPWSPAWNGIPAMAAAVCAAPATAEAAISSEHGTASSTVQWNVPPAIVPVLPPGFCGPIPVPVIPPPSVWPLITPWPNAAWSAPWLGPSASVPPGSSRSSGSSTCSDSGCGSGSPVLGKHSRESRPQGDEKAERRCLWIPKTLRIDDPVEAAKSSIWTTLGIEPGDRGMFRPFQSKHGRQQELQASGAARALQANPAALSRSQSFQETT

SEQ ID NO: 295 - protein, 317 aa, Arabidopsis thaliana
  misc_feature (51)..(113): Pfam Name: zf-Dof Pfam Description: Dof domain, zinc finger
  misc_feature: Bit score of 575.4 for HMM based on sequences of Figure 2
  misc_feature: Functional Homolog Of SEQ ID NO. 263
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSLLLESQSIKNETSMATNNHVWYPVPMTREKTQEFSFFSNGAETKSSNNRFVPETYLNLQANPAAMARSMNFRESI

SEQ ID NO: 296 - protein, 317 aa, Arabidopsis thaliana
  misc_feature (51)..(113): Pfam Name: zf-Dof Pfam Description: Dof domain, zinc finger
  misc_feature: Bit score of 572.5 for HMM based on sequences of Figure 2
  misc_feature: Functional Homolog Of SEQ ID NO. 263
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 297 - protein, 437 aa, Oryza sativa subsp. japonica
  misc_feature (90)..(152): Pfam Name: zf-Dof Pfam Description: Dof domain, zinc finger
  misc_feature: Public GI ID no. 78708599
  misc_feature: Bit score of 570.1 for HMM based on sequences of Figure 2
  misc_feature: Functional Homolog Of SEQ ID NO. 263
MGECRGGGGGGDGLIKLFGKTIPVQPDAKDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 298 - protein, 486 aa, Oryza sativa subsp. japonica
  misc_feature (139)..(201): Pfam Name: zf-Dof Pfam Description: Dof domain, zinc finger
  misc_feature: Public GI ID no. 15451553
  misc_feature: Bit score of 566.5 for HMM based on sequences of Figure 2
  misc_feature: Functional Homolog Of SEQ ID NO. 263
MGGGGKCKRGKRGKIAAKRRRGQCCSSSSSSGGARRRARERESEESLGEMGECRGGGGGGDGLIKLFGKTIPVQPDAKDVQQHSGSSSSSTESDVQETAAVAVADPSPRSEVVDGESPPQPGGEAASHQQQQKEMKLKKPDKILPCPRCSSMDTKFCYFNNYNVNQPRHFCKHCQRYWTAGGAMRNVPVGAGRRKNKNATAAAHFLHRVRACAAAAAMPAAPHDATNATVLSFGGGGGGHDAPPVTLDLADKMTRLGKEGLVAHARNADAAAACSEVSSNRDDEQIGNTVAKPANGLQQHPPPPHHHHHSAMNGGGIWPYYTSGIAIPIYPAAPAYWGCMIPPPGAWSLPWPATVQSQAISSSSPPTSATPSVSSFTLGKHPREGGDHEARDHHGNGKVWVPKTIRIDNADEVARSSIRSLFAFRGGDKADDNNDDDGTGVHKLATTVFEPKRDSKTAKHPAITSLPLLHTNPVALTRSATFQEGS

SEQ ID NO: 299 - protein, 338 aa, Oryza sativa subsp. indica
  misc_feature (101)..(163): Pfam Name: zf-Dof Pfam Description: Dof domain, zinc finger
  misc_feature: Public GI ID no. 125542572
  misc_feature: Bit score of 490.7 for HMM based on sequences of Figure 2
  misc_feature: Functional Homolog Of SEQ ID NO. 263
MGECKVGGGGGGGDCLIKLFGKTIPVPEPGACAAGDVDKDLQHSGSSTTEPKTQENTVQDSTSPPPQPEVVDTEDSSADKNSSENQQQQGDTANQKEKLKKPDKILPCPRCSSMDTKFCYYNNYNINQPRHFCKNCQRYWTAGGAMRNVPVGAGRRKSKSVSAASHFLQRVRAALPGDPPLYAPVKTNGTVLSFGSDLSTLDLTEQMKHLKDKFIPTTGIKNTDEMPVVSTMTNCFRLGKHPRDGDEELDSKGNGKVWVPKTVRIDDVDEVARSSIWSLIGIKGDKVGADHGRGCKLAKVFESKDEAKTSTHTAISSLPFMQGNPAALTRSVTFQEGS

SEQ ID NO: 300 - protein, 367 aa, Vitis vinifera
  misc_feature (109)..(171): Pfam Name: zf-Dof Pfam Description: Dof domain, zinc finger
  misc_feature: Public GI ID no. 157342426
  misc_feature: Bit score of 441.6 for HMM based on sequences of Figure 2
  misc_feature: Functional Homolog Of SEQ ID NO. 263
MQEPKDPAFKLFGKTIPMLADGDAPVSSGDVGDSGAAVAREDGLEEETEKDALGGKPAETKGEDGSEESRNSETVAESNENPKTPSIAEENAEKGQSDSPDSQEKTLKKPDKILPCPRCNSMDTKFCYYNNYNINQPRHFCKSCQRYWTAGGTMRNVPVGAGRRKNKNSASHYRHITISEALQTVRIEATNGVHQPTLKSNGTVLTFGSDAPFCDSMTSAKRNSHGVPSRIPCIPGIPWPYPWNSAVPPPFCPPGFPMPFYPAAYWNWDILKPSIVEDEETPKQRSSERCLWVPKTLRIDDPAEAAKSSIWTTLGIKNDKVDSVSGGGLFNAFHLKGDDKNHAIDTSAVLRANPAALSRSLNFQESS

SEQ ID NO: 301 - DNA, 1802 bp, Arabidopsis thaliana
  misc_feature: Ceres Annot ID no. 538622
  misc_feature: Encodes the peptide sequence at SEQ ID NO. 302
aaagacaaaaaagcattcccaattaacaaatctagaaatcaaaactcagacaaccaccgataacaagacagtcgtttctctctctcttttaaacaaataaaaattggaacttttttcctctgtcttctcaaaaagtttccgctttttgctcgctggagaagaaagaaagaaagaagtgaaaaggaatcattaccatggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatagaaagaagaagaatctaagcagctgatttgattgtttttgggttcagtcttgtgttccaagaaagcaggtgagtccttttgtacatatagctatatatacacacacatgtttgtgtatatatatataatggttgacatagtgagggataagtagtttttggattgcagagtgaaagtttgttgtatcataaatgaaaaaacctcaaaactgtagttaaataaatgtatcttgcat

SEQ ID NO: 302 - protein, 457 aa, Arabidopsis thaliana
  misc_feature (133)..(195): Pfam Name: zf-Dof Pfam Description: Dof domain, zinc finger
  misc_feature: Ceres Annot ID no. 538622
  misc_feature: Bit score of 432.8 for HMM based on sequences of Figure 2
  misc_feature: Functional Homolog Of SEQ ID NO. 263
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 303 - DNA, 1479 bp, Solanum lycopersicum
  misc_feature: Ceres Annot ID no. 8460661
  misc_feature: Encodes the peptide sequence at SEQ ID NO. 304
atgacttgtgattcagagatcaagctgtttggcaagatactcccggtggtcgtctccggcgttggtaggggtttgtctggtagtgatggtgttatatatgatggaaatagaaatgggtctgatcttgatcgatgtttagagggaagtaaagcaagcagtgtagagaaggatgaaggaagtgagtatgaaaagcaagaagctgaaaaggataatataactggagagctcagtgaagctaaatctgaggagggagaccaaaatcagatgatagaagaatcagaaaatcctaagactccatcagaatcagagagcagtcctaaatcttcaactgaggaagaccctcaagcagtaaaatcatccaagactgagaatgaaccgactaatgtgacaaattccgagcagaacaatctgaagaagccagacaaaatcctcccatgccctcgttgcaatagtttggatacaaaattctgttactataataacaacaatgtcaaccagcctcgtcatttctgcaggagctgccagaggtattggactgccggtggtaccatgaggaatctccctgtgggagctggtcgtcgcaagaacaagaatcttgcatctcaatatcgtaatataagtatccctgaaggattactagcagcaggaattgaatctccaaatgggttaattcatcatccattattcaaaccaaatggcactattctatcgtttggtcccgacttacccctgtgtgaacctatggcttctgcattaaatcaagcagagaaaagggtatcaactggtattcaaaacggttctcataaatcagaagtcaagaattcttcttgcaaaggtggagattctggggatgagtgctgtagagggattaacatcccgactccaaatatgatggtggaagaaggtaaaggagagccccacaaggctgttatgcatagtataaatggcatcccgtctcctgttccgtgcctccatggagtaccttggccttttccatggaatgctgcagttcctgtgtcggctatttgccccattcccttccctatgccattcttccctacaccttattggaattgcagtgtgcctccttggagtaatccttggttgagtccacctctgcgagctgcaaacgagaaaacatcaggttctgatcctacttcttctttagggaaacattcaagagagggggatttgcttaagccaagcaatcctgggggcaaagaacaatcagaacaaaagtattcagaggggtctattttggtcccaaaaacattgcggattgatgatcctgatgaagctgctaagagttctatatggtcaacacttgggattaaatatgattctactaacaggggagagtttttcaaggccttgcaaccaaaaagcaatgacaagcacaacaaagccaatacatttccagtattgcatactaaccctgcagccttatctagatctatcaccttccaacaaggtgcctaa

SEQ ID NO: 304 - protein, 492 aa, Solanum lycopersicum
  misc_feature (139)..(201): Pfam Name: zf-Dof Pfam Description: Dof domain, zinc finger
  misc_feature: Ceres Annot ID no. 8460661
  misc_feature: Bit score of 432.2 for HMM based on sequences of Figure 2
  misc_feature: Functional Homolog Of SEQ ID NO. 263
MTCDSEIKLFGKILPVVVSGVGRGLSGSDGVIYDGNRNGSDLDRCLEGSKASSVEKDEGSEYEKQEAEKDNITGELSEAKSEEGDQNQMIEESENPKTPSESESSPKSSTEEDPQAVKSSKTENEPTNVTNSEQNNLKKPDKILPCPRCNSLDTKFCYYNNNNVNQPRHFCRSCQRYWTAGGTMRNLPVGAGRRKNKNLASQYRNISIPEGLLAAGIESPNGLIHHPLFKPNGTILSFGPDLPLCEPMASALNQAEKRVSTGIQNGSHKSEVKNSSCKGGDSGDECCRGINIPTPNMMVEEGKGEPHKAVMHSINGIPSPVPCLHGVPWPFPWNAAVPVSAICPIPFPMPFFPTPYWNCSVPPWSNPWLSPPLRAANEKTSGSDPTSSLGKHSREGDLLKPSNPGGKEQSEQKYSEGSILVPKTLRIDDPDEAAKSSIWSTLGIKYDSTNRGEFFKALQPKSNDKHNKANTFPVLHTNPAALSRSITFQQGA

SEQ ID NO: 305 - protein, 457 aa, Arabidopsis thaliana
  misc_feature (133)..(195): Pfam Name: zf-Dof Pfam Description: Dof domain, zinc finger
  misc_feature: Public GI ID no. 15983797
  misc_feature: Bit score of 432.1 for HMM based on sequences of Figure 2
  misc_feature: Functional Homolog Of SEQ ID NO. 263
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEARTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 306 - protein, 551 aa, Oryza sativa subsp. japonica
  misc_feature (163)..(225): Pfam Name: zf-Dof Pfam Description: Dof domain, zinc finger
  misc_feature: Public GI ID no. 115435804
  misc_feature: Bit score of 428.4 for HMM based on sequences of Figure 2
  misc_feature: Functional Homolog Of SEQ ID NO. 263
MCDKDPGIKLFGRVIPLAPEAEAAAAADGSDQPEAAAAAAAEVEPAAQDEDHHKETEERKYDEMKVDVPQEEEDNEMKVDAPQEKKDNEVTADVPEEKGNDEMRVDASESIESIEPVSRSTLDNKKEDQGQMNNVEEKAASDSKDENEKTANDESGQDKVLKKPDKILPCPRCNSMDTKFCYYNNYNVNQPRHFCKNCQRYWTAGGTMRNVPVGAGRRKSKSSSLHYRHLLMAPDCMMGSRVEISKSMNPEAFASAHSTPIQPIGRNETVLKFGPEVPLCESMASVLNIQEQNGTNAAAVPTGENQEDNSCISSITSHNVLPENAAQVDKNSTPVYCNGVGPVPQYYLGAPYMYPWNIGWNNVPMMVPGTSMPESASQSESCSTSSAPWMNMNSPMMPVASRLSAPPFPYPLVPPALWGCLSSWPATAWNIPWIRTNGGCMSPSSSSNSSCSGNGSPLGKHSRDSSLPLKEDKEEKSLWVPKTLRIDDPDEAAKSSIWATLGIKPGDPGIFKPFQSKGESKGQAASETRPARALKANPAALSRSQSFQETS

SEQ ID NO: 307 - DNA, 2039 bp, Zea mays
  misc_feature: Ceres Clone ID no. 1599579
  misc_feature: Encodes the peptide sequence at SEQ ID NO. 308
gttttcccccaattccgcaacaccccgctactatatccattactgcctcagcctgtctctctcctccagcttggttccttcctctcgccgcttcgagagcgcgtagtcagcagcggcttgcgttcctgtcggtctcgcaggcgggagcagagcaggacgaggatgtcggatcagaaggatcctgggatcaagctcttcggccgggtgatcccgtgggggcctgaaaccgccccgggaaccacggaagtggaggacccgccgcaggatgagctgcagccacgggcgccggaggttgccgcggcggtggatgaggatgaacacaatgagaaggaagagaaaaatgctaatgaagtggttgtcatgccacaagagaagggtaaagaaaccaaggttgacacgccacaagaggagaagggtaatgaaatggaggttgacgcgccacaaaaggaacatgacgacgaaatgaaaattgacgcacaacgagaggaaaaagacgaacaaacggatgccaacgcatcaccaacgcatggaaatatagaaccagccaatctacctccctcaggcctgatggacagtgccgaagataaagcagcatcagatgcaaagggggagaacgagaagacatcaaatgaggaatcaggccaggacaaggcacttaataagaagccagataagatcctaccttgccctcggtgcaacagcatggatacaaagttctgctattacaacaactacaacgtgaatcaaccaaggcacttctgcaagaactgccagcggtactggactgcagggggcaccatgaggaacgtacctgttggtgccgggcggcgcaagagtaagaacgcgtcattgcactaccgtcaattactgatggcccctgactgtatgctggggcctagagtggacatatcaaagccagtgctccctgaagctcttgcatcatctccacctgccccgacacagccagccagtagaaatggaacggtcctaaaatttgggcctgaggtaccattttgcgagtcaatggtgtcggcgctgaacattgatgagcagaacgtgaacagccctggaggaccaacagcaagaggtgaaaacagggaagataataataaccctggatccggcacaccaccatacaacggtgtgcctgaaaccatggcccccgtcgtcggcaagaacggggcaccagttcattgtaacggggttgccccagtgcctcagtattaccttggaacccctttcatgtacccttggagtgtaggatggagcaacgtgcctgtgatggtgccaggtaaaagcatgcccgaacctgctcctgctccagagagctgcagtactagctcagctgtatggatgaaccctcccatgatgccgggctcaagacctcctagcccagcgtttccataccctctcgtgccacccgggctctggggctgtttttccggatggccacccacggcttggaacgtaccatggaccagaaccaacgtctccgtgtcgccgccgccatcgccatcaagcaacagcagcagctgctcgggcaacgggtctcctactctgggcaagcattccagggacaccaatccgctgagagaggagaaaagagagaagtcgctgtgggttcccaagacgctccggatcgatgaccctgatgacgccgccaagagttcgatatgggccaccctcggcatcaagcccggtgaccctggcactttcatcaagcctttccagtccaaggtcgagagcaagggccagaggtcggacgctgctcaggtcttgcaggcgaacccagcggcgttgtcgcgcttacagtcgttccaggagagctcttgacttcatacgcaaagtctgccttatatagttatatatagttttggtactgtaatccttacatgctggtagagttttgtggcatgtggaaagtgacttcatacctgcagcctatcttattgtttgtttcggtactgtattccttactgcatgctagtagagctgtgcggtatgtggaaaggtcaacagagagcttcttgtttagccac

SEQ ID NO: 308 - protein, 556 aa, Zea mays
  misc_feature (168)..(230): Pfam Name: zf-Dof Pfam Description: Dof domain, zinc finger
  misc_feature: Ceres Clone ID no. 1599579
  misc_feature: Bit score of 418.6 for HMM based on sequences of Figure 2
  misc_feature: Functional Homolog Of SEQ ID NO. 263
MSDQKDPGIKLFGRVIPWGPETAPGTTEVEDPPQDELQPRAPEVAAAVDEDEHNEKEEKNANEVVVMPQEKGKETKVDTPQEEKGNEMEVDAPQKEHDDEMKIDAQREEKDEQTDANASPTHGNIEPANLPPSGLMDSAEDKAASDAKGENEKTSNEESGQDKALNKKPDKILPCPRCNSMDTKFCYYNNYNVNQPRHFCKNCQRYWTAGGTMRNVPVGAGRRKSKNASLHYRQLLMAPDCMLGPRVDISKPVLPEALASSPPAPTQPASRNGTVLKFGPEVPFCESMVSALNIDEQNVNSPGGPTARGENREDNNNPGSGTPPYNGVPETMAPVVGKNGAPVHCNGVAPVPQYYLGTPFMYPWSVGWSNVPVMVPGKSMPEPAPAPESCSTSSAVWMNPPMMPGSRPPSPAFPYPLVPPGLWGCFSGWPPTAWNVPWTRTNVSVSPPPSPSSNSSSCSGNGSPTLGKHSRDTNPLREEKREKSLWVPKTLRIDDPDDAAKSSIWATLGIKPGDPGTFIKPFQSKVESKGQRSDAAQVLQANPAALSRLQSFQESS

SEQ ID NO: 309 - DNA, 1485 bp, Populus balsamifera subsp. trichocarpa
  misc_feature: Ceres Annot ID no. 1469831
  misc_feature: Encodes the peptide sequence at SEQ ID NO. 310
atgaagggtgagtctaaagatccagctttcaagctctttggtaggaagattcctgtacctgatactcagtttccggccgaaccactagccaagggaacctgcagtgagataacaagagtagaaaccaagggtcctagtgaagacatctcagaagaacctgaaatgttctctggttctggacaaggcaaggaagaaagccaagctgcaatgcgagtgaatgaggcacaagtaattgctaagcataaggaaggtccactggagactaatggcacagaccaagagaaagtccttaagaagccagataaaattctaccatgtccacgatgcaacagtttagacacaaaattctgttacttcaataactataatgtcaaccaaccaaggcatttctgcaagaattgccaaagatattggacagctgggggatcaatgagaaatgtccctattggtgctggccggcggaagaataagcacttagccactcaatatcgtcagatattagtatcttctgatgggatgcctattgccagaatggaaaactcagactcaatcggtcaccaacttcaatcttctgttgaatccggaaccaccttgagtccctcagtagcaaatggaatggttctaaaattcggtcatgaagcacctctttgtgattccatggagaatgtgctgaatcttggagaccaaaagagatatgttgagataagttcagtcaatcgtcaagataatgtagaagagccgtcttcatgtggatcctccaagacagcttccaatgcttgggcaaacgaattgcgagaaaatattatgcagaaagagcaagttgatgtgccagcatcttctaacgaactcagcgcaccaaattccctgccttattattctgttccttcatgggtttttccttggaacccgggttggaataatgttgcttccatgaccgcagctcagcactccactggccaggcttgcgtgacaaatattcccaatcaagttcaattgtgctccacaccaatgttggctgttcccagcatttgccctccaaacattcctttacaatttgtacccgcttcttattggggttgcatgcccacatgggctgctggaacaagaaatgtatcattgagtggatcgaatggctgcctttctctatcaacctctgctaacaccagttcctgctcaggaaatggctcaccaaccctaggcaagcattctagagattcaaaatttatggaagaagagaaggcagaaaaatgtatattggtcccaaaaacactaagaattgatgacccaagtgaggcttcaaagagtcctttatgggctacattaggtcttaagcctgaccagaaggatcccgcatcaaaaggtactatcttcaagaattttgaaaccaaagcagaatgctatggccatgtatctgatatcactcatgtactggaagcaaacccagcagctctttctcgctctcatacattccaggagagtggctaa

SEQ ID NO: 310 - protein, 494 aa, Populus balsamifera subsp. trichocarpa
  misc_feature (99)..(161): Pfam Name: zf-Dof Pfam Description: Dof domain, zinc finger
  misc_feature: Ceres Annot ID no. 1469831
  misc_feature: Bit score of 411.8 for HMM based on sequences of Figure 2
  misc_feature: Functional Homolog Of SEQ ID NO. 263
MKGESKDPAFKLFGRKIPVPDTQFPAEPLAKGTCSEITRVETKGPSEDISEEPEMFSGSGQGKEESQAAMRVNEAQVIAKHKEGPLETNGTDQEKVLKKPDKILPCPRCNSLDTKFCYFNNYNVNQPRHFCKNCQRYWTAGGSMRNVPIGAGRRKNKHLATQYRQILVSSDGMPIARMENSDSIGHQLQSSVESGTTLSPSVANGMVLKFGHEAPLCDSMENVLNLGDQKRYVEISSVNRQDNVEEPSSCGSSKTASNAWANELRENIMQKEQVDVPASSNELSAPNSLPYYSVPSWVFPWNPGWNNVASMTAAQHSTGQACVTNIPNQVQLCSTPMLAVPSICPPNIPLQFVPASYWGCMPTWAAGTRNVSLSGSNGCLSLSTSANTSSCSGNGSPTLGKHSRDSKFMEEEKAEKCILVPKTLRIDDPSEASKSPLWATLGLKPDQKDPASKGTIFKNFETKAECYGHVSDITHVLEANPAALSRSHTFQESG

SEQ ID NO: 311 - protein, 515 aa, Arabidopsis thaliana
  misc_feature (133)..(195): Pfam Name: zf-Dof Pfam Description: Dof domain, zinc finger
  misc_feature: Public GI ID no. 9758342
  misc_feature: Bit score of 404.5 for HMM based on sequences of Figure 2
  misc_feature: Functional Homolog Of SEQ ID NO. 263
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRKQTNSNKFKGTFIVIHMMYDSQNLESDLTYWTSVVVAATSLFSASAEERTTVFNFLDDRDVKCLPW

SEQ ID NO: 312 - protein, 447 aa, Arabidopsis thaliana
  misc_feature (105)..(167): Pfam Name: zf-Dof Pfam Description: Dof domain, zinc finger
  misc_feature: Public GI ID no. 21536859
  misc_feature: Bit score of 401.2 for HMM based on sequences of Figure 2
  misc_feature: Functional Homolog Of SEQ ID NO. 263
MMMETRDPAIKLFGMKIPFPSVFESAVTVEDDEEDDWSGGDDKSPEKVTPELSDKNNNNCNDNSFNNSKPETLDKEEATSTDQIESSETPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAHQQHVAPMAPVMKLQGDQKVSNGARNGFHGLADQRLVARVENGDDCSSGSSVTTSNNHSVDESRAQSGRIVEPQMNNNNNMNGYACIPGVPWPYTWNPAMPPPGFYPPPGYPMPFYPYWTIPMISPSPHQSSSPISQKDSNTNSPTLGKRSRDEESSKRDSETERKQRTGCILVPKTLRIDDPNEAAKSSIWTTLGIKNEAMCKAGGMFKGFDHKTKMYNNDKAENSPVLSANPAALSRSHNFHEQI

SEQ ID NO: 313 - DNA, 1535 bp, Arabidopsis thaliana
  misc_feature: Ceres Clone ID no. 113639
  misc_feature: Encodes the peptide sequence at SEQ ID NO. 314
accaattcacactctcccaaatctctcttctttaaatacaacaaaaaaaaaaatcacagagacatagagagaagaagaaacagagactccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgrcaacagttttaacaattcgaaacccgaaaccttggacaaagaggaagcgacatcaactgatcagatagagagtagtgagacgcctgaggataatcagcagacgacacctgatggtaaaaccctgaagaaaccgactaagattctgccgtgtccgagatgtaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgatccgggtttgcaggcaaacacaagggtcttgagttttggtctcgaagctcatcagcagcatgttgctcctatggcacctgtgatgaagctacaaggagatcaaaaggtctcaaacggagctaggaacgggtttcatgggttagcggatcaacggcttgtagctcgggtagagaatggagatgactgctcaagcggatcctctgtgaccacctctaacaatcactcagtggatgaatcaagagcacaaagcggcagaattgttgaaccacaaatgaacaacaataacaacatgaatggttatgcttgcatcccaggtgttccatggccttacacgtggaatccagcgatgcccccaccaggtttttacccgcctccagggtatccaatgccgttttacccttactggaccatcccaatgatatcaccgtcaccgcatcaatcctcatcgcctatcagccaaaaggattcaaatacaaactctcccactctcggaaaacgctcgagagatgaagaatcatcgaaaagggacagtgagacagagcgaaaacagaggaccgggtgcattctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagccgagaactcccctgttctttctgctaaccctgctgctctatcaagatcacacaatttccatgaacagatttagagttacatatgtatatgtatatatgtatgattgattgtatgtatagatgatattggagaatgatgagtttttgagaatcaaactcttttcttctt

SEQ ID NO: 314 - protein, 447 aa, Arabidopsis thaliana
  misc_feature (105)..(167): Pfam Name: zf-Dof Pfam Description: Dof domain, zinc finger
  misc_feature: Ceres Clone ID no. 113639
  misc_feature: Bit score of 400.8 for HMM based on sequences of Figure 2
  misc_feature: Functional Homolog Of SEQ ID NO. 263
  misc_feature (62)..(62): Xaa is any aa, unknown, or other
MMMETRDPAIKLFGMKIPFPSVFESAVTVEDDEEDDWSGGDDKSPEKVTPELSDKNNNNCNXNSFNNSKPETLDKEEATSTDQIESSETPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAHQQHVAPMAPVMKLQGDQKVSNGARNGFHGLADQRLVARVENGDDCSSGSSVTTSNNHSVDESRAQSGRIVEPQMNNNNNMNGYACIPGVPWPYTWNPAMPPPGFYPPPGYPMPFYPYWTIPMISPSPHQSSSPISQKDSNTNSPTLGKRSRDEESSKRDSETERKQRTGCILVPKTLRIDDPNEAAKSSIWTTLGIKNEAMCKAGGMFKGFDHKTKMYNNDKAENSPVLSANPAALSRSHNFHEQI

SEQ ID NO: 315 - protein, 448 aa, Arabidopsis thaliana
  misc_feature (105)..(167): Pfam Name: zf-Dof Pfam Description: Dof domain, zinc finger
  misc_feature: Public GI ID no. 15232818
  misc_feature: Bit score of 399.6 for HMM based on sequences of Figure 2
  misc_feature: Functional Homolog Of SEQ ID NO. 263
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 316 - DNA, 1989 bp, Zea mays
  misc_feature: Ceres Clone ID no. 1571328
  misc_feature: Encodes the peptide sequence at SEQ ID NO. 317
gcttgtggctgtgcacccctcgccgtggcccccacccaccttcttcccctcttatacccgctcgcctgtccatagcaggcagcagcacaccataccagatttgagatttcaatgaccttccttttgccggcctcctcgtctcctccggttccggctacctacctgcgggacgtcgacctcgtccgtctgtcgcctagctagctgcctcggttttcgcttgaagcagcagcagcagcaagccgggagcttctgtgtttgtttcgatcggagtgagaagaagatggttgcggagtgccaaggaggaggagacttcctcatcaagctcttcgggaagaccatccccgtgccggagccggagccggagtccggcgacgccaaggatcttcagcagagcagcagcaactggacggagatcgtggacgccgatgacgaccccaagaagcacagcgacggcgacgctgccaggcagagggagaagctgagggagcccgacaaggtgctgccgtgcccgcgctgtaacagcgcggacaccaagttctgctacttcaacaactacaacgcgaagcagccgcgccacttctgcaagcgctgccagcgctactggaccgcgggcggcgccatgcgcaacgtgccagtgggggccggccgccgcaagaacaagaacgccgccgcctcgcactcgcacctcctccataggacgacgacgactgccaacggcgcgatgctcagcttcgcccctcccggtcctggccttgcctgcctctgcctggacctcgccgcgcagttcggccacctggccccggtcagggacgccgccgggaccccgtctcgtccttgcacttgcagcgaagggtcgaccgacagggacggcacgtcttccgtcgtagacgaatctgcagcaagcggggacggaccagtgcagctgcaccaccacccagcaagcgttaacaccgggtggccgccatacagcagcccacctccggcggcgccgtatttctcgccgggcatctcgattccggtataccccgccgcgccggggtactggggctgcatggttcccggggcttggagcctgccatggccggtgcagccgcagcccccgtcgtcgcggtcgcaggggcagggcctctcgtcgtcgtcgtcgccgccgccgcccaccaccaccaccatcggtactccttcagtctcatcatcatccggggccgctgactttgactcccacgccctggggctgggcctgggcaagcacccgcgggaccgggacggcgacgacgggaggaagaggaacggcagtgcccatggcagcggcagcgccaaggtgtgggctcccaagaccatccggatagacgatgtggacgaggtggccaggagctccatctggtccctcgtcggggtcagaggcgacagggagcagcagggcgcagccgcgcaggtgacaagctcgggacagtgttcgagcccaggggcctgcaggccaccaagaaggccatggcgacaagctcgccgctccttcacgccaaccccgtcgcgctcacgcgctcggtggcgttccatgagggctcttgattttgccatctcaacatgatgctcctaatcagactgacagcactgatttgttttggataaatcatcagaggacccctcacatgcacgctgattcacatacctctttggttgcgtaggagaatcagactcctcgtatgcattgaccataactcgactcatgtttagtacgctgcatcttaaaaactgagcacacatacactggtgcaacctaatgttatttaggtgcacctgtagatacccagaaaacttacgtattcgggcggccaggctcacacgagcctcccatgcaagcagagatccaatcacactggtagctacttgtggacggcggggcggcacgcaatttggatgggagaaagaacaggagatcaataagaggttcctgctcgtagataaataaataacattatctaactttttcat

SEQ ID NO: 317 - protein, 434 aa, Zea mays
  misc_feature (69)..(131): Pfam Name: zf-Dof Pfam Description: Dof domain, zinc finger
  misc_feature: Ceres Clone ID no. 1571328
  misc_feature: Bit score of 398.3 for HMM based on sequences of Figure 2
  misc_feature: Functional Homolog Of SEQ ID NO. 263
MVAECQGGGDFLIKLFGKTIPVPEPEPESGDAKDLQQSSSNWTEIVDADDDPKKHSDGDAARQREKLREPDKVLPCPRCNSADTKFCYFNNYNAKQPRHFCKRCQRYWTAGGAMRNVPVGAGRRKNKNAAASHSHLLHRTTTTANGAMLSFAPPGPGLACLCLDLAAQFGHLAPVRDAAGTPSRPCTCSEGSTDRDGTSSVVDESAASGDGPVQLHHHPASVNTGWPPYSSPPPAAPYFSPGISIPVYPAAPGYWGCMVPGAWSLPWPVQPQPPSSRSQGQGLSSSSSPPPPTTTTIGTPSVSSSSGAADFDSHALGLGLGKHPRDRDGDDGRKRNGSAHGSGSAKVWAPKTIRIDDVDEVARSSIWSLVGVRGDREQQGAAAQVTSSGQCSSPGACRPPRRPWRQARRSFTPTPSRSRARWRSMRALDFAIST

SEQ ID NO: 318 - DNA, 1288 bp, Panicum virgatum
  misc_feature: Ceres Clone ID no. 1868988
  misc_feature: Encodes the peptide sequence at SEQ ID NO. 319
gacacaaattgggcaaatctttttaccctttctggcgtcgccaactccacttgtcggatcttgcccatatgctatggagctcgccggagccgcgtcccctcggtcgccggaatcccacgtggcgccgccccgcccgcctccgcagccgccggagaaggatgcatgcgaagatacaggggacatgagtattactggggaaaagccatgcacacatcaggagttagactttggtcagacaaatagttctagccttaacagttccagtgagcgtgagaatcaggcacccagcaatgacgaaatgactggatcagagtccaatttggagacagccaagactgagggcgatgtaccgagtggagagaaggtcctgaagaaaccagataagatcctgccatgccctcgttgcaacagcatggatacaaagttctgttattacaacaactacaacattaagcaaccaaggcatttttgcaagagttgtcagaggtactggactgcaggtgggagcatgagaaatattcctgtcggtgctggtaggcgcaagagcaagagctctagttcgaattgccgcagcatattgattcccggcagtagtgtagccactcctgtgggagagtctaccctctttccattgcctatcaacggaaatcaagcagcagttaacttcgggcctgattcccctctctgcaactccatggcctcggtgctgaagattggaggggagcagagtaagaatgccaaccctgcctcaacagcacagccaagaaatggagaaacccagatttgcccaccttctacgacaacatcagacggtcctcggagtgaatctcataaaggaacagtgagtgcacatcagaatggagttgttgggcatggcaacggggtcacttccatgcatcctataccattcttccctggccctccttttgtgtacccatggagtccagcatggaatggcgttcctgccgcggcagcaccggtatgcccagccccagcagaagctgtgaattcttcagaaaatggcaacagtagtagtagtgttcaatggaattttccaccattggtgtcggtactgccaccaggattctgcggtgcacctattccagttcctgtaatgccatcttcagtttggccattcattacgccttggcccaatggagcatggaacacaccatggctcggacctggcgtgtcagcatcatctcccacaggcagcaccacatgttcagatagcgggtcacctgtcctggggaaacactcaagagactccagacctcaaggtgatgag

SEQ ID NO: 319 - protein, 405 aa, Panicum virgatum
  misc_feature (101)..(163): Pfam Name: zf-Dof Pfam Description: Dof domain, zinc finger
  misc_feature: Ceres Clone ID no. 1868988
  misc_feature: Bit score of 389.4 for HMM based on sequences of Figure 2
  misc_feature: Functional Homolog Of SEQ ID NO. 263
MELAGAASPRSPESHVAPPRPPPQPPEKDACEDTGDMSITGEKPCTHQELDFGQTNSSSLNSSSERENQAPSNDEMTGSESNLETAKTEGDVPSGEKVLKKPDKILPCPRCNSMDTKFCYYNNYNIKQPRHFCKSCQRYWTAGGSMRNIPVGAGRRKSKSSSSNCRSILIPGSSVATPVGESTLFPLPINGNQAAVNFGPDSPLCNSMASVLKIGGEQSKNANPASTAQPRNGETQICPPSTTTSDGPRSESHKGTVSAHQNGVVGHGNGVTSMHPIPFFPGPPFVYPWSPAWNGVPAAAAPVCPAPAEAVNSSENGNSSSSVQWNFPPLVSVLPPGFCGAPIPVPVMPSSVWPFITPWPNGAWNTPWLGPGVSASSPTGSTTCSDSGSPVLGKHSRDSRPQGDE

SEQ ID NO: 320 - protein, 380 aa, Cucurbita maxima
  misc_feature (35)..(97): Pfam Name: zf-Dof Pfam Description: Dof domain, zinc finger
  misc_feature: Public GI ID no. 1669341
  misc_feature: Bit score of 378.8 for HMM based on sequences of Figure 2
  misc_feature: Functional Homolog Of SEQ ID NO. 263
MNPEVLSTDENDKLATRKTEKEQNDAPNSKEKLKKPDKILPCPRCNSMETKFCYYNNYNVNQPRHFCKACQRYWTEGGTIRNVPVGAGRRKNKNSASHYRHITISEALRAAQIDVPIEVNHLASKGNGRVLNFSVSPPVCESMVNVSHPAERKVLNGTRNEFEGAKGPCEGGETGDDCSSASSVTMSSSMKNGARRFPQEPHMQNINGFPSQIPCLPGVPWPCSWTAPIPPPALCPPGVPLSFYPATYWSCSASGSWNIPWVTPQPCPPIPGPNSPTLGKHSRDGDELQADNSEMKDPPKQKNGSVLVPKTLRIDDPNEAAKSSIWETLGIKNDSIKAVDLSNVFQSKGDLKSNVSEVLSPVLQANPAALSRSLTFHERS

SEQ ID NO: 321 - protein, 420 aa, Vitis vinifera
  misc_feature (24)..(86): Pfam Name: zf-Dof Pfam Description: Dof domain, zinc finger
  misc_feature: Public GI ID no. 157359317
  misc_feature: Bit score of 346.9 for HMM based on sequences of Figure 2
  misc_feature: Functional Homolog Of SEQ ID NO. 263
MSGLQVHKDQGETNSSAQEKVLKKPDKILPCPRCNSLETKFCYFNNYNVNQPRHFCKNCQRYWTAGGTMRNVPVGAGRRKNKHLASQYRQIMVSSDGVPTTVIEASDSSNQQILSCGETSTTFRPSTASGTVLKFGPEAPLCKSMETVLSIREQKRCAEMRTVNCGGNGEEPSSCASSVSAPSFPENEFPENVGHKDRPSLPASRSEIHPQLHQPCYPVPPWAFPWNPGWTNVAPVAPPQCSSDTVYAPNNSNPNSVQWCSRPMLAVPGFCAPTIPLQLVPPSYWGCMPIWGAGTGNISLAGSNDCLSPSSSTSNSCSGNASPTLGKHSRDAQPAEEQKLEKCVLVPKTLRIIDPDEASKSSIWATLGIKPDQKAPISKGGIFKAFEPKSGAKTDLSDATQVLEANPAALSRSQTFKEST

SEQ ID NO: 322 - DNA, 458 bp, Glycine max
  misc_feature: Ceres Clone ID no. 638126
  misc_feature: Encodes the peptide sequence at SEQ ID NO. 323
tttatcagtcatggcgtcaagctctctcagcaaacaaaaggcttctgactcctcttggacaccaaaacagaacaagctgtttgaaaaagcacttgcaaaatatgacaaggatacccctgaccgatggcagaatgtagccaaagcagtaggtggaaaatctgcagatgaagttaagagacactatgaaatcctcttggaggatctgagacacattgagtctggtcatgttcctcttcccaagtacaagtccacaggaagcagcaccaatgttgaggaagaagagaggcttctgaagtatcttaaactgaattgatggaagcaatgtttatgttatcctcagctattggcagaatttatgtggccatccttgaatctgcggaaatatcttccctctctgttctatttcctgccattgtaatttagattgtttcaaatttcaatgaattatcctattctag

SEQ ID NO: 323 - protein, 100 aa, Glycine max
  misc_feature (13)..(62): Pfam Name: Myb_DNA-binding Pfam Description: Myb-like DNA-binding domain
  misc_feature: Ceres Clone ID no. 638126
  misc_feature: Bit score of 196.0 for HMM based on sequences of Figure 7
MASSSLSKQKASDSSWTPKQNKLFEKALAKYDKDTPDRWQNVAKAVGGKSADEVKRHYEILLEDLRHIESGHVPLPKYKSTGSSTNVEEEERLLKYLKLN

SEQ ID NO: 324 - protein, 96 aa, Vitis vinifera
  misc_feature (9)..(58): Pfam Name: Myb_DNA-binding Pfam Description: Myb-like DNA-binding domain
  misc_feature: Public GI ID no. 157340812
  misc_feature: Bit score of 192.4 for HMM based on sequences of Figure 7
  misc_feature: Functional Homolog Of SEQ ID NO. 323
MASGSRMGSGLWTSKQNKLFEKALALYDKDTPDRWQNVAKAVGGKSAEEVKRHYEILIEDLKHIESGHVPIPNYKSTGSNSIGDQEQRLLKCIKLQ

SEQ ID NO: 325 - DNA, 375 bp, Populus balsamifera subsp. trichocarpa
  misc_feature: Ceres Annot ID no. 1460824
  misc_feature: Encodes the peptide sequence at SEQ ID NO. 326
atgtcttcaagctatcaagcttccagaaattctagatccgcttggacaccaagggaaaacaaactgtttgaaaaggcactagccttgtttgataaggacacaccggacaggtggcaaaatatagccaaagctgttggtggtgtgaaatctgccgaggaagtgaagaaacactatgaaatccttattgaagatcttcaacatatcgagtctggccgcattcctattcctaagtacaagtctagtggaagctgcaacaacacaaacgaagaggaaagtgaagttaataagaacaaactgcagatggcaactggcaatctccatattgactcattgagagtcctccaggatttcatggcagggtgtaatcaacattaa

SEQ ID NO: 326 - protein, 124 aa, Populus balsamifera subsp. trichocarpa
  misc_feature (12)..(62): Pfam Name: Myb_DNA-binding Pfam Description: Myb-like DNA-binding domain
  misc_feature: Ceres Annot ID no. 1460824
  misc_feature: Bit score of 189.9 for HMM based on sequences of Figure 7
  misc_feature: Functional Homolog Of SEQ ID NO. 323
MSSSYQASRNSRSAWTPRENKLFEKALALFDKDTPDRWQNIAKAVGGVKSAEEVKKHYEILIEDLQHIESGRIPIPKYKSSGSCNNTNEEESEVNKNKLQMATGNLHIDSLRVLQDFMAGCNQH

SEQ ID NO: 327 - protein, 100 aa, Arabidopsis thaliana
  misc_feature (11)..(60): Pfam Name: Myb_DNA-binding Pfam Description: Myb-like DNA-binding domain
  misc_feature: Public GI ID no. 145356202
  misc_feature: Bit score of 191.8 for HMM based on sequences of Figure 7
  misc_feature: Functional Homolog Of SEQ ID NO. 323
MASSSMSSQSSGSWTAKQNKAFEQALATYDQDTPNRWQNVAKVVGGKTTEEVKRHYELLVQDINSIENGHVPFPNYRTSGGCTNGRLSQEEKRMRNMRLQ

SEQ ID NO: 328 - DNA, 729 bp, Glycine max
  misc_feature: Ceres Clone ID no. 477814
  misc_feature: Encodes the peptide sequence at SEQ ID NO. 329
atcaactcttccttgagtctgatcactatatacacactactcttcagccttttcatatttcataacacccctttgctaccaaaccaattcagtgatctttttgctttgctctttcctgagtttgaaaaccttagaaccatttcagtacacaacactttctgttccttaatggcatccagttcaatctcagcctctggctcatggagtgttaaggacaacaaggcctttgaaaaggctttagctgtttatgacaaggacactcctgaccgttggtacaatgttgctcatgctgttggtggcaaaactccagaggaagtgaaaaggcactacgaactccttgttcaggatgttaagcatattgagtctggacgtgtgccattcccaaattacaagaaaactacttcagggtcaactgatcaggaggaaaaaaggctgaggaatttgaatttgaacctccagtgacccccctcaagaacaacaaattgattttctaattttcatatcaaccaacatcattaatttccagcatccctggtagtactacgtggtgttatgtcacacataattgctagtgcaatagcatcttaggctatattagtcatcataagaatcatatgtcccgtgattccatctggtactttcttgtcgttgaagcttcctcttgaaagggtcaacgaccgtttcagttcctcatcgtcctaaataaatttataattttataatatgctg

SEQ ID NO: 329 - protein, 97 aa, Glycine max
  misc_feature (9)..(58): Pfam Name: Myb_DNA-binding Pfam Description: Myb-like DNA-binding domain
  misc_feature: Ceres Clone ID no. 477814
  misc_feature: Bit score of 185.2 for HMM based on sequences of Figure 7
  misc_feature: Functional Homolog Of SEQ ID NO. 323
MASSSISASGSWSVKDNKAFEKALAVYDKDTPDRWYNVAHAVGGKTPEEVKRHYELLVQDVKHIESGRVPFPNYKKTTSGSTDQEEKRLRNLNLNLQ

SEQ ID NO: 330 - DNA, 735 bp, Gossypium hirsutum
  misc_feature: Ceres Clone ID no. 1914387
  misc_feature: Encodes the peptide sequence at SEQ ID NO. 331
accatcatccccttgacttcagtcttctcccttgacgggggcggcaatctcttcttcttcttcttccttcttagctactttctcttttgtcggttactcttcctttaagatctcatcttgaaagtcttacattcccttttttattcacccccaacgtaaaaaatggcatcctctattacgctttcacgtgattctaactcctactggactccaaagcaaaacaagctatttgaaagggcacttgctgtatatgacaaggacactccagaccgctggcaaaaggtggctgcagctgtgggggagaaatcagtcgaggaagtaagaaggcattatgagatcctagtgagggatctcatgtatatagaatctggtcaaatccctatacccaattacaaaagcactgggagtaacagaagatgaattgctggggtgcaaaggtttatgaagaatctaaggctccaatgaagcacaagtttcagctgcactgtcagagaatctgtaaaaactaaaataaaaagaataaattataaagaactggagaatttgcatcgtgattctccctgtcttattttacattgagtgatcgagtcagtttggttttttctttttgtgtgtgtgtgtcagtttgttaatatgacaacaaaagttgaactctacaattattaaatttgtgagtattgtactgaagttaccagttttaaattaaaaaaaaaaggtattactactaaatgctgg

SEQ ID NO: 331 - protein, 85 aa, Gossypium hirsutum
  misc_feature (12)..(61): Pfam Name: Myb_DNA-binding Pfam Description: Myb-like DNA-binding domain
  misc_feature: Ceres Clone ID no. 1914387
  misc_feature: Bit score of 158.6 for HMM based on sequences of Figure 7
  misc_feature: Functional Homolog Of SEQ ID NO. 323
MASSITLSRDSNSYWTPKQNKLFERALAVYDKDTPDRWQKVAAAVGEKSVEEVRRHYEILVRDLMYIESGQIPIPNYKSTGSNRR

SEQ ID NO: 332 - protein, 88 aa, Solanum lycopersicum
  misc_feature (11)..(60): Pfam Name: Myb_DNA-binding Pfam Description: Myb-like DNA-binding domain
  misc_feature: Public GI ID no. 7981380
  misc_feature: Bit score of 162.1 for HMM based on sequences of Figure 7
  misc_feature: Functional Homolog Of SEQ ID NO. 323
MSSMSSQHGSSGSWTAKQNKAFEKALAVYDKETRDRWSNVAKAVGGKTAEEVKRHYEILLRDVFFIDNGMVPFPKYKTTGGSHNSTSD

SEQ ID NO: 333 - DNA, 749 bp, Panicum virgatum
  misc_feature: Ceres Clone ID no. 1910072
  misc_feature: Encodes the peptide sequence at SEQ ID NO. 334
atcagctcatcagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtcagccgaggaggtcaggcgctactacgagatgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcagaggatggtcaagaagaggctgcgcaggcacacgtgtatatatgattgggatagcatgcatgtccatgctactcctacgcaagtggtctggaagaagcaagaagaatcagatgagatgcatgcatgtcataattaattaattaattaattaataattagtatggggatgatcgagtagtatcctagcctgtcacgcgagatcgaccgacccatcgatctcccagcatgtgtccttcgtacccacgcgcgtatgtgtattatatcctagctgcatctgtgtaccataccaatcagaaacatga

SEQ ID NO: 334 - protein, 100 aa, Panicum virgatum
  misc_feature (12)..(61): Pfam Name: Myb_DNA-binding Pfam Description: Myb-like DNA-binding domain
  misc_feature: Ceres Clone ID no. 1910072
  misc_feature: Bit score of 182.3 for HMM based on sequences of Figure 7
  misc_feature: Functional Homolog Of SEQ ID NO. 323
MASLSMTSSSVRAQWTKKQNKLFEQALAVYDKDTPDRWHNIARAVGGKSAEEVRRYYEMLEEDVKHIESGKVPLPAYRCPGGAGAGALGYEADRMKHLKI

SEQ ID NO: 335 - DNA, 675 bp, Zea mays
  misc_feature: Ceres Clone ID no. 331755
  misc_feature: Encodes the peptide sequence at SEQ ID NO. 336
agaatgcaaaccacaaaacaaagtcaaaccagctgcaacgatcaagagcgaggcttccttgtccagctctccgctcagccgacacacacagattgacagatggcgtctatgtcgctgagctcgtcgagggcgcagtggacggcgaagcagaacaagctgttcgagcaggcgttggcggtgtacgacagggacacgccggaccgctggcacaacatcgcgcgcgccgtgggtggcaagtcggcggacgaggtcaggcgctactacgagctgctggtgaaggacttggagcacatcgaggccggcaaggtggccttccccgcgtacaggtgccccggcggctacgacgacgccgacagcgacaggctgaagcacctgacctgaagatctaggcggcaggcaagcatcatgagaaccactgaacaagtacgtcctacatacgtacacttcgcgccatgtgagtgtagcacgtgtggctacaaaagaagcaagccaagcgagtgggtcggacggattatctgttcaagcacgcatgtgaattagaattactactagcaatagctataggatgttgatcaatcgatctccgttccccccgtgttgcgatgtaaaatctcagcatctgtagcatatatattctgaggagtgaaataaaatacattcactagtttgtggacc

SEQ ID NO: 336 - protein, 93 aa, Zea mays
  misc_feature (10)..(59): Pfam Name: Myb_DNA-binding Pfam Description: Myb-like DNA-binding domain
  misc_feature: Ceres Clone ID no. 331755
  misc_feature: Bit score of 175.6 for HMM based on sequences of Figure 7
  misc_feature: Functional Homolog Of SEQ ID NO. 323
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 337 - protein, 92 aa, Medicago truncatula
  misc_feature (9)..(58): Pfam Name: Myb_DNA-binding Pfam Description: Myb-like DNA-binding domain
  misc_feature: Public GI ID no. 124360540
  misc_feature: Bit score of 178.1 for HMM based on sequences of Figure 7
  misc_feature: Functional Homolog Of SEQ ID NO. 323
MASSSMSASGSWSVKENKAFERALAVYDKDTPDRWYNVAHAVGGKTPEEVKKHYELLVEDIKHIESGKVPFPNYKKISVSHEEKRMRNMSLH

SEQ ID NO: 338 - protein, 102 aa, Vitis vinifera
  misc_feature (13)..(62): Pfam Name: Myb_DNA-binding Pfam Description: Myb-like DNA-binding domain
  misc_feature: Public GI ID no. 157335318
  misc_feature: Bit score of 170.5 for HMM based on sequences of Figure 7
  misc_feature: Functional Homolog Of SEQ ID NO. 323
MASHAFSSSCYSSSSWTQKQNKLFEEALALYDKNTPDRWANIAKAVGGKSAEEVKRHYEILEQDVMHIENGQVPLPIYRSTGSSSGGSVDEQRHLLKNLKLR

SEQ ID NO: 339 - DNA, 279 bp, Populus balsamifera subsp. trichocarpa
  misc_feature: Ceres Annot ID no. 1503394
  misc_feature: Encodes the peptide sequence at SEQ ID NO. 340
atgtcttccagccatcaaactccaaggaattctagctcctcttggacaccaagggaaaacaaactgtttgaaaaggctctagccttgtttgataaggacacaccggaccggtggcaaaatatagccaaagctgttggtggcgtgaaatcagctgaggaaatgaagagacactacgaaatcctcattgaagatcttaaacatatcgagtccggccgtgttcctattcctaattacaagtccagtagaagctacagcaatacaaacgaagaagaaaggtaa

SEQ ID NO: 340 - protein, 92 aa, Populus balsamifera subsp. trichocarpa
  misc_feature (12)..(62): Pfam Name: Myb_DNA-binding Pfam Description: Myb-like DNA-binding domain
  misc_feature: Ceres Annot ID no. 1503394
  misc_feature: Bit score of 163.2 for HMM based on sequences of Figure 7
  misc_feature: Functional Homolog Of SEQ ID NO. 323
MSSSHQTPRNSSSSWTPRENKLFEKALALFDKDTPDRWQNIAKAVGGVKSAEEMKRHYEILIEDLKHIESGRVPIPNYKSSRSYSNTNEEER

SEQ ID NO: 341 - DNA, 315 bp, Populus balsamifera subsp. trichocarpa
  misc_feature: Ceres Annot ID no. 1442707
  misc_feature: Encodes the peptide sequence at SEQ ID NO. 342
atgtcttatttcacatcttcaaatggctccggctcctcttggacagccaaacaaaataagctattcgagaaggccctggctgtatacgacaaagacaccccagaccgctggcaaaatgtggccaaggccgtgggtggcaagtctcctgaagaagttaagaggcactatgatcgtctcgtggaagatctcgtgtacatagaatccggccaagcccctctgccgaattacaagccctctggcagcaatggtaggggacttgttgaagagcaaaggctagctatggtctatccatcatcgatctattcaacttcctaa

SEQ ID NO: 342 - protein, 104 aa, Populus balsamifera subsp. trichocarpa
  misc_feature (11)..(60): Pfam Name: Myb_DNA-binding Pfam Description: Myb-like DNA-binding domain
  misc_feature: Ceres Annot ID no. 1442707
  misc_feature: Bit score of 159.1 for HMM based on sequences of Figure 7
  misc_feature: Functional Homolog Of SEQ ID NO. 323
MSYFTSSNGSGSSWTAKQNKLFEKALAVYDKDTPDRWQNVAKAVGGKSPEEVKRHYDRLVEDLVYIESGQAPLPNYKPSGSNGRGLVEEQRLAMVYPSSIYSTS

SEQ ID NO: 343 - protein, 75 aa, Vitis vinifera
  misc_feature (9)..(58): Pfam Name: Myb_DNA-binding Pfam Description: Myb-like DNA-binding domain
  misc_feature: Public GI ID no. 147784500
  misc_feature: Bit score of 136.5 for HMM based on sequences of Figure 7
  misc_feature: Functional Homolog Of SEQ ID NO. 323
MASTSLKSSGSWTPKQNKLFEKALALYDRDTPDRWQNVANAVGGKSAEEVKQHYEILIRDLKHIESGRVPIPNYK

SEQ ID NO: 344 - DNA, 273 bp, Populus balsamifera subsp. trichocarpa
  misc_feature: Ceres Annot ID no. 1514100
  misc_feature: Encodes the peptide sequence at SEQ ID NO. 345
atggcatcaagctcaatgtcctctcgcggttcgggctcgtggactgttcagcagaacaaagcctttgaaagggctttggctgtgtatgacagagacacgcccgatcgctggtacaatgtagccagggcagtcggtggaaaaaccgcagaagaagtgaaaaggcactatgaactgcttgtggaggatgtgaagcatattgagtcgggccatgttcccttccctaattacaggactaccggggcaaatggccacgcaagagacgggattgtttag

SEQ ID NO: 345 - protein, 90 aa, Populus balsamifera subsp. trichocarpa
  misc_feature (11)..(60): Pfam Name: Myb_DNA-binding Pfam Description: Myb-like DNA-binding domain
  misc_feature: Ceres Annot ID no. 1514100
  misc_feature: Bit score of 165.2 for HMM based on sequences of Figure 7
  misc_feature: Functional Homolog Of SEQ ID NO. 323
MASSSMSSRGSGSWTVQQNKAFERALAVYDRDTPDRWYNVARAVGGKTAEEVKRHYELLVEDVKHIESGHVPFPNYRTTGANGHARDGIV

SEQ ID NO: 346 - DNA, 294 bp, Arabidopsis thaliana
  misc_feature: Ceres Annot ID no. 850366
  misc_feature: Encodes the peptide sequence at SEQ ID NO. 347
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 347 - protein, 97 aa, Arabidopsis thaliana
  misc_feature (11)..(60): Pfam Name: Myb_DNA-binding Pfam Description: Myb-like DNA-binding domain
  misc_feature: Ceres Annot ID no. 850366
  misc_feature: Bit score of 174.5 for HMM based on sequences of Figure 7
  misc_feature: Functional Homolog Of SEQ ID NO. 323
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 348 - DNA, 303 bp, Arabidopsis thaliana
  misc_feature: Ceres Annot ID no. 543794
  misc_feature: Encodes the peptide sequence at SEQ ID NO. 349
atggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggttaatgaagaatatgagaatccagtga

SEQ ID NO: 349 - protein, 100 aa, Arabidopsis thaliana
  misc_feature: Ceres Annot ID no. 543794
  misc_feature (9)..(66): Pfam Name: Myb_DNA-binding Pfam Description: Myb-like DNA-binding domain
  misc_feature: Bit score of 158.4 for HMM based on sequences of Figure 7
  misc_feature: Functional Homolog Of SEQ ID NO. 323
MASSSMSSSSSWTSKQNKMFERALAVYDKDTPDRWQNVAKAVGSKSAEEVKRHYDILVEDLMNIEQDLVPLPKYKTVDVGSKSRGIDDFDLRLMKNMRIQ

SEQ ID NO: 350 - DNA, 327 bp, Populus balsamifera subsp. trichocarpa
  misc_feature: Ceres Annot ID no. 1495620
  misc_feature: Encodes the peptide sequence at SEQ ID NO. 351
atgtcttatttcacatcttcaaatggctccggctcctcttggacagccaaacaaaataagctattcgagaaggccctggctgtatacgacaaagacaccccagaccgctggcaaaatgtggccaaggccgtgggtggcaagtctcctgaagaagttaagaggcactatgatcgtctcgtggaagatctcgtgtacatagaatccggccaagcccctctgccgaattacaagccctctggcagcaatggtaggggacttgttgaagagcaaagaccatttaatccaactccaaaaagttttgaatttgtacgatccctgtttgcctag

SEQ ID NO: 351 - protein, 108 aa, Populus balsamifera subsp. trichocarpa
  misc_feature (11)..(60): Pfam Name: Myb_DNA-binding Pfam Description: Myb-like DNA-binding domain
  misc_feature: Ceres Annot ID no. 1495620
  misc_feature: Bit score of 154.5 for HMM based on sequences of Figure 7
  misc_feature: Functional Homolog Of SEQ ID NO. 323
MSYFTSSNGSGSSWTAKQNKLFEKALAVYDKDTPDRWQNVAKAVGGKSPEEVKRHYDRLVEDLVYIESGQAPLPNYKPSGSNGRGLVEEQRPFNPTPKSFEFVRSLFA

SEQ ID NO: 352 - DNA, 469 bp, Glycine max
  misc_feature: Ceres Clone ID no. 1653552
  misc_feature: Encodes the peptide sequence at SEQ ID NO. 353
aacacatcagctcttccttgagtctgatcactacacactactcttcagccttttcatatcaccctttgctaccaaaccaattcagtctctttgcttgttctacctgagtttgaaacgtaaccttagaaccatttcacacaacactttctgttccttaattcctgaaagaaaatggcatcttgttcaatctcagcctcaggctcatggagtgttaaggacaacaaggcctttgaaaaggctctagctgtttatgacaaggacacccctgaccgttggtacaatgttgctcatgctgttggcggcaaaactccagaggaagtgaagaggcactacgaactccttgttcaggatgttaagcatattgagtcaggacgtgttccattcccaaattacaagaaaactacttcagagtcaactgatcaggaggaaaaaaggctgaggaatttgaatttgaacctccagtgacccc

SEQ ID NO: 353 - protein, 97 aa, Glycine max
  misc_feature (9)..(58): Pfam Name: Myb_DNA-binding Pfam Description: Myb-like DNA-binding domain
  misc_feature: Ceres Clone ID no. 1653552
  misc_feature: Bit score of 184.1 for HMM based on sequences of Figure 7
  misc_feature: Functional Homolog Of SEQ ID NO. 323
MASCSISASGSWSVKDNKAFEKALAVYDKDTPDRWYNVAHAVGGKTPEEVKRHYELLVQDVKHIESGRVPFPNYKKTTSESTDQEEKRLRNLNLNLQ

SEQ ID NO: 354 - protein, 96 aa, Vitis vinifera
  misc_feature (7)..(56): Pfam Name: Myb_DNA-binding Pfam Description: Myb-like DNA-binding domain
  misc_feature: Public GI ID no. 147767321
  misc_feature: Bit score of 164.7 for HMM based on sequences of Figure 7
  misc_feature: Functional Homolog Of SEQ ID NO. 323
MSSRSSGSSWTAKQNKAFEEALAVYDKDTPDRWYNVARAVGGKTVEEVKRHYEILVEDIKSIDSDKVPFPNYKTTGASSRSNMSDQEKRMMNLKLR

SEQ ID NO: 355 - DNA, 237 bp, Populus balsamifera subsp. trichocarpa
  misc_feature: Ceres Annot ID no. 1510450
  misc_feature: Encodes the peptide sequence at SEQ ID NO. 356
atgtcttccaattctctcacctcttggacacctaagcaaaacaaactattcgaaaaggccctggctttacatgacaaggacacccctgaccgctggcataatgttgccaaagctgtgggtgggaaatctgcagaggaagtgaagaggcactatgagattctcatcaaggatgtcagggaaattgagtctggcagagttccattccctaattacaggtcaagtggaaacggcaactaa

SEQ ID NO: 356 - protein, 78 aa, Populus balsamifera subsp. trichocarpa
  misc_feature (6)..(55): Pfam Name: Myb_DNA-binding Pfam Description: Myb-like DNA-binding domain
  misc_feature: Ceres Annot ID no. 1510450
  misc_feature: Bit score of 137.5 for HMM based on sequences of Figure 7
  misc_feature: Functional Homolog Of SEQ ID NO. 323
MSSNSLTSWTPKQNKLFEKALALHDKDTPDRWHNVAKAVGGKSAEEVKRHYEILIKDVREIESGRVPFPNYRSSGNGN

SEQ ID NO: 357 - protein, 97 aa, Glycine max
  misc_feature (9)..(58): Pfam Name: Myb_DNA-binding Pfam Description: Myb-like DNA-binding domain
  misc_feature: Public GI ID no. 110931736
  misc_feature: Bit score of 183.1 for HMM based on sequences of Figure 7
  misc_feature: Functional Homolog Of SEQ ID NO. 323
  misc_feature (94)..(94): Xaa is any aa, unknown, or other
MASCSISASGSWSVKDNKAFEKALAVYDKDTPDRWYNVAHAVGGKTPEEVKRHYELLVQDVKHIESGRVPFPNYKKTTSESTDQEEKRLRNLNXNLQ

SEQ ID NO: 358 - DNA, 665 bp, Gossypium hirsutum
  misc_feature: Ceres Clone ID no. 1916884
  misc_feature: Encodes the peptide sequence at SEQ ID NO. 359
acacaccgcaccttgacttgaagtaaccttttgagagaaaaagtccatctattcccttccatcatcgtttcaatttattcaacctttctctcaaattcagtcacaggcatatttattttaagttttagcctgccattcacccgagcttgtcgataaatcctctgttttcaatagttgcatttggattttcatcaaatggcatcccattctctcagttcttcacgtagctctaactcctcctggacacctaagcaaaacaaaatgttcgagaaggctctggctgaatttgaccaggacactcctgagcgctggattaatattgctaaagctgtgggtggaaagtcagctgaggaagtcaagcagcactatgagatcctagtcagggatgtcaaagagatcgagtctggacggtacccttatccatatccaagtgggagcagcaactaaagcagtgagttatcagcttaccgtatccaaagggttctctgaagggtcaaagatcatagtgaaagaacattatattatgcaaccagagacctcaattgcaggaagactattatagaatattccccaggaaaatattattatttgctttatttatctttttgtatttttctttgaccttgtctagttagattaaatgttaaatatattttattgatatt

SEQ ID NO: 359 - protein, 83 aa, Gossypium hirsutum
  misc_feature (13)..(62): Pfam Name: Myb_DNA-binding Pfam Description: Myb-like DNA-binding domain
  misc_feature: Ceres Clone ID no. 1916884
  misc_feature: Bit score of 122.1 for HMM based on sequences of Figure 7
  misc_feature: Functional Homolog Of SEQ ID NO. 323
MASHSLSSSRSSNSSWTPKQNKMFEKALAEFDQDTPERWINIAKAVGGKSAEEVKQHYEILVRDVKEIESGRYPYPYPSGSSN

SEQ ID NO: 360 - DNA, 1123 bp, Gossypium hirsutum
  misc_feature: Ceres Clone ID no. 1847251
  misc_feature: Encodes the peptide sequence at SEQ ID NO. 361
ataccactcccttaacttcaaacaaaatcttcttttaagagtcccttccatcaccttgctttcacattcaggcacctgcatacttcttttaacttttcagccctataattctctcacttaagattttcaccaatggcatctaattctctcacttcctcacgtacctctggctcgtcctggacggcaaagcaaaacaaactgttcgagaaggctctggctaaatatgacaaagacactcctgaccgctggcataacattgccaaggctgtgggtggaaagtcagttgaggaagtcaagctgcactatgagatcctagtcagggatctcaaagacattgagtctggccgctacccttatccatatccaaccaactaaagcgctatgagtttactacttactattcactacctatccacaatcactatagataaccaagaagtgaaggccactttcatatgcatgaatcacattcctaaaaatgcagctgtcatgcttttttgttgatgtagttgtggatttaaagaaaacgtggttcttagaattatcatacatgcgcatatccatgacgtccttgtccttccagctccacacacccacaaccccaaagtccttaagcattgaaaactctcaagtacccaagtgggtccataaaagaaaatccagaaaagtagggaatcttcatgtgcctcccccccccccccccaaatttctttctgtggtctatcactttaaatttttttcctttttccactgagcatatacagttcatttgcatttaatgttcttatagacctaattccttacaattactcaatcctaatctcaaatctttcgactctttttgtctttttggattttggacaacatgccgatggtacttttgtcatttccaacatattttatcttaattatctgcatttgtttttctcacaggagcaaatcaataaattccgtttctagagacttaacttgtcctacttgtctttcaggttagctgaagactatgaatatatatatgcatctagagacctcagttgctgagagactagcctagttccccacctaaagaaatccatacaaaactaattatcccattggtgtaatactaaatgctgttactacc

SEQ ID NO: 361 - protein, 80 aa, Gossypium hirsutum
  misc_feature (13)..(62): Pfam Name: Myb_DNA-binding Pfam Description: Myb-like DNA-binding domain
  misc_feature: Ceres Clone ID no. 1847251
  misc_feature: Bit score of 115.8 for HMM based on sequences of Figure 7
  misc_feature: Functional Homolog Of SEQ ID NO. 323
MASNSLTSSRTSGSSWTAKQNKLFEKALAKYDKDTPDRWHNIAKAVGGKSVEEVKLHYEILVRDLKDIESGRYPYPYPTN

SEQ ID NO: 362 - DNA, 339 bp, Populus balsamifera subsp. trichocarpa
  misc_feature: Ceres Annot ID no. 1457249
  misc_feature: Encodes the peptide sequence at SEQ ID NO. 363
atgtcttccaattctctcacctcttggacacctaagcaaaacaaactattcgaaaaggccctggctttacatgacaaggacacccctgaccgctggcataatgttgccaaagctgtgggtgggaaatctgcagaggaagtgaagaggcactatgagattctcatcaaggatgtcagggaaattgagtctggcagagttccattccctaattacagattaatgtcatatacaagtattaaagcatcatttaagccaggatacaggcaacgtagatttctgatctttcaggacaaattccatgggaatggtcaatcaaattctgcaccgtcattcgcctaa

SEQ ID NO: 363 - protein, 112 aa, Populus balsamifera subsp. trichocarpa
  misc_feature (6)..(55): Pfam Name: Myb_DNA-binding Pfam Description: Myb-like DNA-binding domain
  misc_feature: Ceres Annot ID no. 1457249
  misc_feature: Bit score of 146.4 for HMM based on sequences of Figure 7
  misc_feature: Functional Homolog Of SEQ ID NO. 323
MSSNSLTSWTPKQNKLFEKALALHDKDTPDRWHNVAKAVGGKSAEEVKRHYEILIKDVREIESGRVPFPNYRLMSYTSIKASFKPGYRQRRFLIFQDKFHGNGQSNSAPSFA

SEQ ID NO: 364 - DNA, 518 bp, Glycine max
  misc_feature: Ceres Clone ID no. 1113584
  misc_feature: Encodes the peptide sequence at SEQ ID NO. 365
aatcacacctctttaattagtaacacttaattttcattaccgtcgttttattaagtgtgtgttgctacaacaatggcctcaagtcagggttggactccgaagcagaacaagagatttgagaatgcccttgccatcttcgacaaggacaccccagacaggtggcacacggtggccagggccgtcggaggaaaaacggtggaggaagtgaaaaggcattatgagaagctcgtggaagatgtgaaggagattgaggaaggtcacgtgcccctccccaattaccgaagtgctgcaagaggccacggttacatggatgaagaaaacaggatgaaggttctgagtctgcagtgaagtgtgatttatcaataatatatataatatatgctggatgcttggcttagaactactataaaatattttatttgctttttcgttttttctttccatatatatatatattcaaagcatcgatgccttgtatttctgtttctataaatgtaaagatgaaatgaaattgtccc

SEQ ID NO: 365 - protein, 91 aa, Glycine max
  misc_feature (4)..(53): Pfam Name: Myb_DNA-binding Pfam Description: Myb-like DNA-binding domain
  misc_feature: Ceres Clone ID no. 1113584
  misc_feature: Bit score of 141.8 for HMM based on sequences of Figure 7
  misc_feature: Functional Homolog Of SEQ ID NO. 323
MASSQGWTPKQNKRFENALAIFDKDTPDRWHTVARAVGGKTVEEVKRHYEKLVEDVKEIEEGHVPLPNYRSAARGHGYMDEENRMKVLSLQ

SEQ ID NO: 366 - DNA, 656 bp, Gossypium hirsutum
  misc_feature: Ceres Clone ID no. 1927753
  misc_feature: Encodes the peptide sequence at SEQ ID NO. 367
aagtaattttctttgagagaaataaccccatcttttccctttatacaagtttcaatttattcactctttcaaattcaggaactgacatagttctctaaatttttagcctgtcattctgatccgaagcttgttaaaaagaccctctgttttcagttgtacttattttcacttatgtcatccaattttctcaataattcacgctgctctagctcttcctggacacctaaacaaaacaaaacgttcgagaaggctctggctaaatatgaccaggacactcctgaccgctggcacaatgttgccaaggctgtgggtggaaagtctgctgaggaagtcaagctgcactatgatgccctagtcagggatctcaaagacattgagtctggccgctacccttatccatatccaagtggaagcaacagctaaagtggttcccaaagagtcaagtactaaaatgaaaaagaacatgatactcacaaaaccagagacctcagtcgcacagtcgcagaaatctagcattggatgatattcccccagaaaaaaagaaaatccctactgtaattgtacatgctgctattactattttctgtattatcactttgtattttcctttgaccttgtctagttaaattaaaatattaaatatttatatagtaatt

SEQ ID NO: 367 - protein, 83 aa, Gossypium hirsutum
  misc_feature (13)..(62): Pfam Name: Myb_DNA-binding Pfam Description: Myb-like DNA-binding domain
  misc_feature: Ceres Clone ID no. 1927753
  misc_feature: Bit score of 110.7 for HMM based on sequences of Figure 7
  misc_feature: Functional Homolog Of SEQ ID NO. 323
MSSNFLNNSRCSSSSWTPKQNKTFEKALAKYDQDTPDRWHNVAKAVGGKSAEEVKLHYDALVRDLKDIESGRYPYPYPSGSNS

SEQ ID NO: 368 - DNA, 551 bp, Glycine max
  misc_feature: Ceres Clone ID no. 857342
  misc_feature: Encodes the peptide sequence at SEQ ID NO. 369
aaaatcacagctctttaatttgtaacacttaattttcattgattgagtgtgtgttgctacaacaatggcctcaagccagggttggactccgaagcagaacaagagatttgagaatgcccttgccatcttcgacaaggacaccccagataggtggcacacggtggccagggccgtcggaggaaaaacggtggaggaagtgaaaaggcattatgagaagctcgtggaagatgtgaagaagatagaggaaggtcacgtgcccctccccaattaccgaagtgctgcaagaggctacggttacatggatgaagaaaccaggatgaaggctctgagtctgcagtgaagtgtgatttaccaataaataatatatgttggatgcttggcttagtaccataagatattttattcacttttttgttttttctttccatataatatataggcaaagcatcgttgccttgtgtttctgtttctataaatgtaaagatgaaattgtcccaaagacgggcccactagttaatagtaaaaacagccattgaatatcatattttcac

SEQ ID NO: 369 - protein, 91 aa, Glycine max
  misc_feature (4)..(53): Pfam Name: Myb_DNA-binding Pfam Description: Myb-like DNA-binding domain
  misc_feature: Ceres Clone ID no. 857342
  misc_feature: Bit score of 139.8 for HMM based on sequences of Figure 7
  misc_feature: Functional Homolog Of SEQ ID NO. 323
MASSQGWTPKQNKRFENALAIFDKDTPDRWHTVARAVGGKTVEEVKRHYEKLVEDVKKIEEGHVPLPNYRSAARGYGYMDEETRMKALSLQ

SEQ ID NO: 370 - DNA, 489 bp, Gossypium hirsutum
  misc_feature: Ceres Clone ID no. 100068619
  misc_feature: Encodes the peptide sequence at SEQ ID NO. 371
ctctttttcttttcttctcttttctttggcctcagacccttaatttcgattgttaattatcactgttctgcaatggcgtcaggttcgaactggacgccaaagcaaaacaagttgttcgagaacgctttagctatctacgacaaggatacaccagaccggtggcacaagctagccagggctgtcggggggaagaccgtggaggaagtgaagttgcattaccagaaccttgtggatgacatcaagcagatagagtctgggcacgtgcctttgcccccttataagaaagctggagggaaccaaggatacaacaatttcatggacgatgaagaaccaaggatgaggaatctcaggctttagtgaagtatgaaccagaaatagctgtagaatatcaacctttcaataaaaggaaatgcaaagcagcaaacatataaattatctcttaatttcgtttacatttcctgctcatatatatgttttttgtgtgcttga

SEQ ID NO: 371 - protein, 94 aa, Gossypium hirsutum
  misc_feature (4)..(53): Pfam Name: Myb_DNA-binding Pfam Description: Myb-like DNA-binding domain
  misc_feature: Ceres Clone ID no. 100068619
  misc_feature: Bit score of 130.0 for HMM based on sequences of Figure 7
  misc_feature: Functional Homolog Of SEQ ID NO. 323
MASGSNWTPKQNKLFENALAIYDKDTPDRWHKLARAVGGKTVEEVKLHYQNLVDDIKQIESGHVPLPPYKKAGGNQGYNNFMDDEEPRMRNLRL

SEQ ID NO: 372 - protein, 97 aa, Arabidopsis thaliana
  misc_feature (9)..(54): Pfam Name: Myb_DNA-binding Pfam Description: Myb-like DNA-binding domain
  misc_feature: Public GI ID no. 145327247
  misc_feature: Bit score of 153.0 for HMM based on sequences of Figure 7
  misc_feature: Functional Homolog Of SEQ ID NO. 323
MASNSRSSISPWTFSQNKMFERALAVYDKDTPDRWHNVAKAVGGKTVEEVKRHYDILVEDLINIETGRVPLPNYKTFESNSRSINDFDTRKMKNLKI

SEQ ID NO: 373 - DNA, 276 bp, Solanum lycopersicum
  misc_feature: Ceres Annot ID no. 8461532
  misc_feature: Encodes the peptide sequence at SEQ ID NO. 374
atggcctcgtggactgcaaggcaaaacaagaagttcgaagaggctttggcgttatatgacagagacacacctgatcgttggcataacattgcaaggtgtgtaggtggaaaatcagctgcagaagtgaagaggcattatgaagtacttgtgaaggatatcatgcaaatagaaaatggtcaagtacctttaccaaattacaaagccgcggctgaaaccaataacagatcaggttatgccaatgaacataggcttctgaagaacctgaagttacagtga

SEQ ID NO: 374 - protein, 91 aa, Solanum lycopersicum
  misc_feature (1)..(50): Pfam Name: Myb_DNA-binding Pfam Description: Myb-like DNA-binding domain
  misc_feature: Ceres Annot ID no. 8461532
  misc_feature: Bit score of 135.9 for HMM based on sequences of Figure 7
  misc_feature: Functional Homolog Of SEQ ID NO. 323
MASWTARQNKKFEEALALYDRDTPDRWHNIARCVGGKSAAEVKRHYEVLVKDIMQIENGQVPLPNYKAAAETNNRSGYANEHRLLKNLKLQ

SEQ ID NO: 375 - DNA, 776 bp, Panicum virgatum
  misc_feature: Ceres Clone ID no. 1722230
  misc_feature: Encodes the peptide sequence at SEQ ID NO. 376
atcagctcatcacaactcttgatctctagctagctaaagagataagcttcctctcttcctctcggtcgaaggagtgatcctctctcactctcaccaggagctcagctcgggtagctcaaggaggccagaagaagaaatggcgtcgctgtcgatgaccagcagctcggtgcgggcgcagtggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccttccccgcctaccgctgccccggcggcgccggcgccggcgccctcggctacgaggccgacaggatgaagcatctgaagatctaggcgaacttcagagtatggtcgagaagaggctgcgcaggcacgtgtattagtgtatatatgattgggacagcatgcatgtccatgctactcctacgcaagtggtctggaagaagcaagaagaatcagatgagatgcatgcatgtcataattaattaattaattaattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgc

SEQ ID NO: 376 - protein, 100 aa, Panicum virgatum
  misc_feature (12)..(61): Pfam Name: Myb_DNA-binding Pfam Description: Myb-like DNA-binding domain
  misc_feature: Ceres Clone ID no. 1722230
  misc_feature: Bit score of 183.0 for HMM based on sequences of Figure 7
  misc_feature: Functional Homolog Of SEQ ID NO. 323
MASLSMTSSSVRAQWTKKQNKLFEQALAVYDKDTPDRWHNIARAVGGKSAEEVRRYYELLEEDVKHIESGKVPFPAYRCPGGAGAGALGYEADRMKHLKI

SEQ ID NO: 377 - DNA, 574 bp, Gossypium hirsutum
  misc_feature: Ceres Clone ID no. 1897493
  misc_feature: Encodes the peptide sequence at SEQ ID NO. 378
cttctacacctctttttcttttctttttttggcctcagaccctgaatttcgattgttaattatcactgttctgcaatggcgtcaggttcgaactggacgccaaagcaaaacaagttgttcgagaacgctttagctatctacgacaaggatacaccagaccggtggcacaagctagccagggctgttggggggaagaccgtggaggaagtgaagttgcattaccagaaccttttggatgacatcaagcagatagagtctgggcacgtgcctttgcccccttacaagaaagctggaggaacaaaggatacaacaatttcatggacgatgaagaaccaaggatgaggaatctcaggctttagtgaagtatgaaccagaaatagcctgtagaatatcaacctttcaataaaaggaaatgcaaagcagcaaacatataaattattgctcttaatttcgtttacatttcccgctcatatatatatatatgttttttgtgtgcttgaatgtaacaagcagccacaacgttcctatacttgcatgtatcaagtatgaaattatagcattggtgccttgtttt

SEQ ID NO: 378 - protein, 88 aa, Gossypium hirsutum
  misc_feature (4)..(53): Pfam Name: Myb_DNA-binding Pfam Description: Myb-like DNA-binding domain
  misc_feature: Ceres Clone ID no. 1897493
  misc_feature: Bit score of 124.3 for HMM based on sequences of Figure 7
  misc_feature: Functional Homolog Of SEQ ID NO. 323
MASGSNWTPKQNKLFENALAIYDKDTPDRWHKLARAVGGKTVEEVKLHYQNLLDDIKQIESGHVPLPPYKKAGGTKDTTISWTMKNQG

SEQ ID NO: 379 - DNA, 381 bp, Arabidopsis thaliana
  misc_feature: Ceres Annot ID no. 838426
  misc_feature: Encodes the peptide sequence at SEQ ID NO. 380
atggcgtcaaactcaagaagttcaatctcaccatggacgtttagtcaaaacaagatgttcgagagggccttggcagtttacgacaaggacacacccgaccgatggcacaatgtggcaaaagctgtcggagggaaaactgtagaagaagtgaagcgccactatgacattctcgtcgaggatctcatcaacatcgagactggtcgtgtccctttgcccaattacaagaccttcgaatctaactcaagaagcatcaatgactttgacacaaggtatataactaaatatctatatatgatgctctcgatatattttgataatcattctagtgattttgagaaattctctcaaaaagttcttgtaagttatatttctttggtttaa

SEQ ID NO: 380 - protein, 126 aa, Arabidopsis thaliana
  misc_feature (9)..(54): Pfam Name: Myb_DNA-binding Pfam Description: Myb-like DNA-binding domain
  misc_feature: Ceres Annot ID no. 838426
  misc_feature: Bit score of 147.8 for HMM based on sequences of Figure 7
  misc_feature: Functional Homolog Of SEQ ID NO. 323
MASNSRSSISPWTFSQNKMFERALAVYDKDTPDRWHNVAKAVGGKTVEEVKRHYDILVEDLINIETGRVPLPNYKTFESNSRSINDFDTRYITKYLYMMLSIYFDNHSSDFEKFSQKVLVSYISLV

SEQ ID NO: 381 - DNA, 306 bp, Arabidopsis thaliana
  misc_feature: Ceres Annot ID no. 827713
  misc_feature: Encodes the peptide sequence at SEQ ID NO. 382
atggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtga

SEQ ID NO: 382 - protein, 101 aa, Arabidopsis thaliana
  misc_feature (11)..(60): Pfam Name: Myb_DNA-binding Pfam Description: Myb-like DNA-binding domain
  misc_feature: Ceres Annot ID no. 827713
  misc_feature: Bit score of 171.4 for HMM based on sequences of Figure 7
  misc_feature: Functional Homolog Of SEQ ID NO. 323
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 383 - DNA, 776 bp, Panicum virgatum
  misc_feature: Ceres Clone ID no. 1763593
  misc_feature: Encodes the peptide sequence at SEQ ID NO. 384
atcagctcatcacagctctcttgatctctagctagagataagcaagcttcctcttcctctcggtcgagcgagcgagtgatcctctctcactcccaccaggagctcgggtaactcaaggaggccagaagaagaaatggcgtcgctgtcgatgaccagtagctcggtgcgggcgcagtggacgaagaagcagaacaagctgttcgagcaggctctggccgtgtacgacaaggacacgcccgaccggtggcacaacatcgcccgcgccgtcggcggcaagtccgccgaggaggtcaggcgctactacgagctgctggaggaggacgtcaagcacatcgagtccggcaaggtgcccttccccgcctaccgctgccccggcggcgccggcgccggcgccggcgccctcggctacgaggccgacaggatgaagcatctgaagatctaggcgaacttcagaggatgatgatggtcgagaagaggctgctcagtgctcacgcacgtgtatatatgattgggacagcatgcatgtccatgctactcttagcaagtggtctggagaagcaagaagaatcagatgagatgcatgcatgttacaatcaattaataatttgtatggggtgatcgagtagtatcctagcctgtcacgcacgcgagatcgaccgacccatcgatctcccagcatgtgtccttcgtacccacgcgtatctgtattatatcctagctgcatctgtgtaccataccaatcaagaaacatgaacttgatattgatgcatttctac

SEQ ID NO: 384 - protein, 102 aa, Panicum virgatum
  misc_feature (12)..(61): Pfam Name: Myb_DNA-binding Pfam Description: Myb-like DNA-binding domain
  misc_feature: Ceres Clone ID no. 1763593
  misc_feature: Bit score of 181.2 for HMM based on sequences of Figure 7
  misc_feature: Functional Homolog Of SEQ ID NO. 323
MASLSMTSSSVRAQWTKKQNKLFEQALAVYDKDTPDRWHNIARAVGGKSAEEVRRYYELLEEDVKHIESGKVPFPAYRCPGGAGAGAGALGYEADRMKHLKI

SEQ ID NO: 385 - DNA, 508 bp, Arabidopsis thaliana
  misc_feature: Ceres Clone ID no. 143475
  misc_feature: Encodes the peptide sequence at SEQ ID NO. 386
aaaatcaagtcctttttcatcaagtcatacatacatcttccttcttctttttttctccctcccaagaagcagatcttgtactctcgatatacaaacttattcgtgatatggcttccaactcaatgagctctagcgcttcttggacacgtaaggagaacaaattatttgaaagggcgttggctacatatgaccaggacactcctgaccgttggcataacgttgcaagagccgttggcggcaaatcagctgaagaagtaaggcgacactacgagctcctcattagggatgtcaatgacattgagtcagggcgttatccacatcccaattaccgttcaaatggaaacaatcactgaaagcattgaaggaactccaaaaggctctactgaagtggacatggttccaaaaccattcacaaagcacatctaagcaaagatatctaaatgtatttacttgtttttgtgttacgaatatgtaagaattatctaaatcaatcaatgtggtttcatat

SEQ ID NO: 386 - protein, 81 aa, Arabidopsis thaliana
  misc_feature (9)..(58): Pfam Name: Myb_DNA-binding Pfam Description: Myb-like DNA-binding domain
  misc_feature: Ceres Clone ID no. 143475
  misc_feature: Bit score of 140.1 for HMM based on sequences of Figure 7
  misc_feature: Functional Homolog Of SEQ ID NO. 323
MASNSMSSSASWTRKENKLFERALATYDQDTPDRWHNVARAVGGKSAEEVRRHYELLIRDVNDIESGRYPHPNYRSNGNNH

SEQ ID NO: 387 - DNA, 237 bp, Solanum lycopersicum
  misc_feature: Ceres Annot ID no. 8456508
  misc_feature: Encodes the peptide sequence at SEQ ID NO. 388
atggcatcaaattcactcactgcttggactccaagagaaaacaagaaattcgagcaggcactcgcggtctacgataaggacacatctgatcgatggcaaaacattgctagatacgttggtgggaaatcagttgaagaagttaaacatcactatgctatacttgtagaggatcttaagcacattgaatctggtgacgtcccattcccaaaatacaagtcaggtggaaagtctcgttaa

SEQ ID NO: 388 - protein, 78 aa, Solanum lycopersicum
  misc_feature (6)..(55): Pfam Name: Myb_DNA-binding Pfam Description: Myb-like DNA-binding domain
  misc_feature: Ceres Annot ID no. 8456508
  misc_feature: Bit score of 124.5 for HMM based on sequences of Figure 7
  misc_feature: Functional Homolog Of SEQ ID NO. 323
MASNSLTAWTPRENKKFEQALAVYDKDTSDRWQNIARYVGGKSVEEVKHHYAILVEDLKHIESGDVPFPKYKSGGKSR

SEQ ID NO: 389 - DNA, 505 bp, Gossypium hirsutum
  misc_feature: Ceres Clone ID no. 100002959
  misc_feature: Encodes the peptide sequence at SEQ ID NO. 390
  misc_feature (24)..(24): n is a, c, t, g, unknown, or other
cattccaaattttgattattttcnttcttttttattttttttatttaaaatttgaaactgctaacattattacattttcattagcctcaagagaagaaaaaaaaatgtcatcgaattcaatgtctgcttcatggacagccaagcaaaacaaagatttcgaaagggctttagctgtttacgacaaggacacaccagatcgttggtacaatgttgctaaagctgtgggagggaaaactgttgaggaagtgaagaagcactatgagcttcttctggaagatgttagacacatcgagtcgggtcgggttcctttccccgactattggaccgttaccgggaatcgtcaagcatgaaagattccgaagctcaaatgaagaagaaaaaatggtggacttgcatggatctcacccttatatgtgtgtgtgtgtgtgtggcagtaattgtagtacttaagaatagccataaatgtatttaggaagaggaagaagagcttaatgggtgatcattg

SEQ ID NO: 390 - protein, 81 aa, Gossypium hirsutum
  misc_feature (7)..(56): Pfam Name: Myb_DNA-binding Pfam Description: Myb-like DNA-binding domain
  misc_feature: Ceres Clone ID no. 100002959
  misc_feature: Bit score of 141.4 for HMM based on sequences of Figure 7
  misc_feature: Functional Homolog Of SEQ ID NO. 323
MSSNSMSASWTAKQNKDFERALAVYDKDTPDRWYNVAKAVGGKTVEEVKKHYELLLEDVRHIESGRVPFPDYWTVTGNRQA

SEQ ID NO: 391 - protein, 93 aa, Antirrhinum majus
  misc_feature (8)..(57): Pfam Name: Myb_DNA-binding Pfam Description: Myb-like DNA-binding domain
  misc_feature: Public GI ID no. 118137433
  misc_feature: Bit score of 157.9 for HMM based on sequences of Figure 7
  misc_feature: Functional Homolog Of SEQ ID NO. 323
MASTRGSGRPWSAKENKAFERALAVYDKDTPDRWANVARAVEGRTPEEVKKHYEILVEDIKYIESGKVPFPNYRTTGGNMKTDEKRFRNLKIR

SEQ ID NO: 392 - DNA, 747 bp, Zea mays
  misc_feature: Ceres Clone ID no. 1523182
  misc_feature: Encodes the peptide sequence at SEQ ID NO. 393
gctcagcatacacaacatcatcatcatcatcttctcgctagtcgagcgagcccttatagttaattaagctagtcgatcgatccaagagaagaagaagcagcagacaggaatggcgtcgctctcgatgacgacgagcgcagcggcccgcgcgcagtggacgcctaggcagaacaagctgttcgagcaggcgctggcggtgtacgacaaggacacgcccgaccgctggcacaacatcgcctgcgccgtcggcggcgggaagtccgcggacgacgtcaggcgctactacgagctgctggaggaggacgtcggccacatcgagtccggcaaggtgcccttccccgcctaccgctaccccgccggctacggggccgccgacaggctgaaacagctgaagatctaggaggtcaattgaacatataggacgaacgatcgatgatccagaagatgcaaacatgtgtgtatataggattaatgggacagtatcagtatgcatgcaatggtccatgctgcaagtgcatgcaagtggtgtgtgaaagcaagaatcagattagatgcatgcatatgcatgtgttaatttagtagtaataattgtagtatgggatgagtcctatactagccagtcacgcgcgatcgaccgaccgacccatcgatctccaatgcttctgttccctctccctcctacttgtccacttgtgtgtatatataaatattatgtatttttattattatatatactctacctgttct

SEQ ID NO: 393 - protein, 96 aa, Zea mays
  misc_feature (13)..(63): Pfam Name: Myb_DNA-binding Pfam Description: Myb-like DNA-binding domain
  misc_feature: Ceres Clone ID no. 1523182
  misc_feature: Bit score of 154.2 for HMM based on sequences of Figure 7
  misc_feature: Functional Homolog Of SEQ ID NO. 323
MASLSMTTSAAARAQWTPRQNKLFEQALAVYDKDTPDRWHNIACAVGGGKSADDVRRYYELLEEDVGHIESGKVPFPAYRYPAGYGAADRLKQLKI

SEQ ID NO: 394 - DNA, 752 bp, Panicum virgatum
  misc_feature: Ceres Clone ID no. 1761808
  misc_feature: Encodes the peptide sequence at SEQ ID NO. 395
atcagctcatcacagctcttgatctctagctagctagagagataagcttcctctcttcctctcggtcgagggagtgatcctctctcactctcaccaggagctcagctcgggtagctcaaggaggccagaagaagaaatggcgtcgctgtcgatgaccagcagctcggtgcgggcgcagaggacgaagaagcagaacaagctcttcgagcaggcgttggccgtgtacgacaaggacacccccgaccggtggcacaacatcgcccgcgccgtcggcggcaagtccgccgaggaggtcaggcgctactacgagctgctggaggaggatgtcaagcacatcgagtccggcaaggtgcccctccccgcctaccgctgccccggcggcgccggcgccggcgccctcggctacgaggccgacaggatgaagcatctgaagatctaggcgaacttcaaaggatggtcgagaagaggctgcgcaggcacgtgtatatatgattgggatagcatgcatgtccatgctactcctacgcaagtggtctggaagaagcaagaagaatcagatgagatgcatgcatgtcataattaattaataattagtatgggatgatcgagtagtatcctagcctgtcacgcgagatcgaccgacccatcgatctcccagcatgtgtccttcgtacccacgcgcgtatgtgtattatatcctagctgcatctgtgtaccataccaatcaagaaacatgaacttgatattgatgc

SEQ ID NO: 395 - protein, 100 aa, Panicum virgatum
  misc_feature (9)..(58): Pfam Name: Myb_DNA-binding Pfam Description: Myb-like DNA-binding domain
  misc_feature: Ceres Clone ID no. 1761808
  misc_feature: Bit score of 174.9 for HMM based on sequences of Figure 7
  misc_feature: Functional Homolog Of SEQ ID NO. 323
MASLSMTSSSVRAQRTKKQNKLFEQALAVYDKDTPDRWHNIARAVGGKSAEEVRRYYELLEEDVKHIESGKVPLPAYRCPGGAGAGALGYEADRMKHLKI

SEQ ID NO: 396 - DNA, 517 bp, Brassica napus
  misc_feature: Ceres Clone ID no. 1069222
  misc_feature: Encodes the peptide sequence at SEQ ID NO. 397
aaaatcaactcatacatacatctttcttcttttactccctccaaagaaaccagatttccattttcaaaacactcttttcgatcttttactaaatggcttccaactccatgagttctaacacttcttggacgcgtaaggagaacaaactatttgaaagggctttggctatatatgagcaggacactcctgaccgatggcataacgttgctagagcagttggtgggaaatcggctgaagaagtaaggagacactacgagctcctcgtaagggatgtcaatgacattgagtcagggcgttatccgcatcctacttaccgttcaaatggaaactgaaagcatttaagctactcaaaaaggttcctctgaaaccaacatgattcgaaaaccagaaacaaacagagaggatctaaacaaagatatatcaaatgtatttacgtctattgtgttatatgtatacgactatgtaagaattttatgctttcatgctaatattaatgaatcaacgtgagtttcacatg

SEQ ID NO: 397 - protein, 79 aa, Brassica napus
  misc_feature (9)..(58): Pfam Name: Myb_DNA-binding Pfam Description: Myb-like DNA-binding domain
  misc_feature: Ceres Clone ID no. 1069222
  misc_feature: Bit score of 129.8 for HMM based on sequences of Figure 7
  misc_feature: Functional Homolog Of SEQ ID NO. 323
MASNSMSSNTSWTRKENKLFERALAIYEQDTPDRWHNVARAVGGKSAEEVRRHYELLVRDVNDIESGRYPHPTYRSNGN

SEQ ID NO: 398 - DNA, 267 bp, Sorghum bicolor
  misc_feature: Ceres Annot ID no. 8734209
  misc_feature: Encodes the peptide sequence at SEQ ID NO. 399
atggcgtcgatgcagtcgatgacgagcgcagcggcgcgcgcgcagtggacgccgaagcagaacaagctgttcgagcaggcgctggccgtttacgacaaggacacgccggaccggtggcacaacatcgcccgcgccgtcggcggcggcaagtccgccgaggacgtcaggcgctactacgacctgctggaggaggacgtcggccacatcgagtccggcaaggtgcccttcccggcctaccgctgcgccaccggctacggggccgcctga

SEQ ID NO: 399 - protein, 88 aa, Sorghum bicolor
  misc_feature (13)..(63): Pfam Name: Myb_DNA-binding Pfam Description: Myb-like DNA-binding domain
  misc_feature: Ceres Annot ID no. 8734209
  misc_feature: Bit score of 144.2 for HMM based on sequences of Figure 7
  misc_feature: Functional Homolog Of SEQ ID NO. 323
MASMQSMTSAAARAQWTPKQNKLFEQALAVYDKDTPDRWHNIARAVGGGKSAEDVRRYYDLLEEDVGHIESGKVPFPAYRCATGYGAA

SEQ ID NO: 400 - DNA, 282 bp, Solanum lycopersicum
  misc_feature: Ceres Annot ID no. 8461540
  misc_feature: Encodes the peptide sequence at SEQ ID NO. 401
atggccacaaattcaacgtggagtcatcatcaaaacaagttatttgagaatgcattggccatttacgacatcgatacaccagatcgatggcgtaaattagccaatgcagttggtggaaaaacagaagaagaagtgaaaaatcactatgaaaaacttgttgaagatattaagcgtatcgaatctggaaatattccattacctaattataatggtggtcgtaataataaaggctacaatttcatggatgaagaacaaaggctgaagtatttgaagctccaatga

SEQ ID NO: 401 - protein, 93 aa, Solanum lycopersicum
  misc_feature (4)..(53): Pfam Name: Myb_DNA-binding Pfam Description: Myb-like DNA-binding domain
  misc_feature: Ceres Annot ID no. 8461540
  misc_feature: Bit score of 121.3 for HMM based on sequences of Figure 7
  misc_feature: Functional Homolog Of SEQ ID NO. 323
MATNSTWSHHQNKLFENALAIYDIDTPDRWRKLANAVGGKTEEEVKNHYEKLVEDIKRIESGNIPLPNYNGGRNNKGYNFMDEEQRLKYLKLQ

SEQ ID NO: 402 - DNA, 408 bp, Brassica napus
  misc_feature: Ceres Clone ID no. 1086604
  misc_feature: Encodes the peptide sequence at SEQ ID NO. 403
gcaaatcaacattttcatcgttaatacaaaccaacttctctaacgtcgctcttttgttattctacattttcacactaatggcttccaactcaattatcagcacttcccggagctctacctcgtcatggacagcgaaacaggacaaacagttcgaaatggctttggctaagttcgagaaggacactcctgaccgatggcaaaatgtggcaagagtagttggtggaaaatcagctgaagaggtaaaaagacgctatgaattgctcgttagagatgttaatgacattgaatcaggacgttacgacccacaacctaggtaccgtaacactaattgaagccattgagattctttgtgagctccggaaaaaataactatgtgcctttaaactctattgagatggagacattaag

SEQ ID NO: 403 - protein, 84 aa, Brassica napus
  misc_feature (14)..(63): Pfam Name: Myb_DNA-binding Pfam Description: Myb-like DNA-binding domain
  misc_feature: Ceres Clone ID no. 1086604
  misc_feature: Bit score of 105.3 for HMM based on sequences of Figure 7
  misc_feature: Functional Homolog Of SEQ ID NO. 323
MASNSIISTSRSSTSSWTAKQDKQFEMALAKFEKDTPDRWQNVARVVGGKSAEEVKRRYELLVRDVNDIESGRYDPQPRYRNTN

SEQ ID NO: 404 - DNA, 481 bp, Arabidopsis thaliana
  misc_feature: Ceres Clone ID no. 41695
  misc_feature: Encodes the peptide sequence at SEQ ID NO. 405
aattcaagtcatctctatccgtcaacaatacaaaccaaccttctcaattcctctcttttcatccacattttcactagctaatggcttctagttcaatgagcacctcatcatggacagctagagaggacaagcaattcgaaatggcgttggcgaaattcgacaaggacactcctgaccgttggcaaaaaattgcaagggcagttggtgggaaatcaactgaagaagtaaagcgacactatgaattgctccttagggatgtgaatgacattgagtcaggacgctatccacaacctaggtaccgtaacactaattgaagccattaataaaatgcctttctatcaagaagaggacatttgagagaatctataaagaactaagaatttcgatgtatttcttatattctatttgctttctttttttgttttttttttaatttctgtttggttttcagatatataataatctctctcaatatccatcc

SEQ ID NO: 405 - protein, 77 aa, Arabidopsis thaliana
  misc_feature (8)..(57): Pfam Name: Myb_DNA-binding Pfam Description: Myb-like DNA-binding domain
  misc_feature: Ceres Clone ID no. 41695
  misc_feature: Bit score of 112.6 for HMM based on sequences of Figure 7
  misc_feature: Functional Homolog Of SEQ ID NO. 323
MASSSMSTSSWTAREDKQFEMALAKFDKDTPDRWQKIARAVGGKSTEEVKRHYELLLRDVNDIESGRYPQPRYRNTN

SEQ ID NO: 406 - protein, 83 aa, Antirrhinum majus
  misc_feature (13)..(62): Pfam Name: Myb_DNA-binding Pfam Description: Myb-like DNA-binding domain
  misc_feature: Public GI ID no. 112292440
  misc_feature: Bit score of 109.3 for HMM based on sequences of Figure 7
  misc_feature: Functional Homolog Of SEQ ID NO. 323
MASSSMTSSRGSSSLWTPKQNRQFEEALTMFDKDTPDRWQNIARRIDGKSAEQVRRYYEELLKDITRIENDQVPIPNYKTNNR

SEQ ID NO: 407 - protein, 78 aa, Arabidopsis thaliana
  misc_feature (8)..(57): Pfam Name: Myb_DNA-binding Pfam Description: Myb-like DNA-binding domain
  misc_feature: Public GI ID no. 116830269
  misc_feature: Bit score of 117.6 for HMM based on sequences of Figure 7
  misc_feature: Functional Homolog Of SEQ ID NO. 323
MASSSMSTSSWTAREDKQFEMALAKFDKDTPDRWQKIARAVGGKSTEEVKRHYELLLRDVNDIESGRYPQPRYRNTNG

SEQ ID NO: 408 - DNA, 663 bp, Panicum virgatum
  misc_feature: Ceres Clone ID no. 1775942
  misc_feature: Encodes the peptide sequence at SEQ ID NO. 409
acaagccacacaggccaagcgagcgatcaagagccagccatcagctctcgcgcgctcagtttagctagctgcttcttctgagagaaattaaagatacatatagctagtaggagatagatggcgtcgatgtcaatgagatcgtcgagggcgcagtggacgaagaagcaggacaagctgttcgagcaggcgctggcggtgtacgacaaggacacgccggaccggtggcacaacatcgcgcgcgccgtggggggcaagtcggcggaggaggtcaggcgctactacgagctgctggaagaggacgtcaagcgcatcgaggccggcaaggtgcccttccccgtctataggtgcccgccggcgccgcccccaattactagctaggcccacaggctgaagcaccagaagatctacgtacgtacttcggcaacaatcatgacatacagtgggtttggctacaaaacagtaactcaaccaagtggccggagcatccgtgcacatatatgaataactaccgctacctctagttaccgcagatcaatcgatctcccatgtatgtagtagtatacgtgttcatctggattctcaatttctcatgtaagatcatctctgtatttgtattatgtatcttgagaaaaagtgaagtaaaaaagtccttcatttcccctt

SEQ ID NO: 409 - protein, 86 aa, Panicum virgatum
  misc_feature (10)..(59): Pfam Name: Myb_DNA-binding Pfam Description: Myb-like DNA-binding domain
  misc_feature: Ceres Clone ID no. 1775942
  misc_feature: Bit score of 143.9 for HMM based on sequences of Figure 7
  misc_feature: Functional Homolog Of SEQ ID NO. 323
MASMSMRSSRAQWTKKQDKLFEQALAVYDKDTPDRWHNIARAVGGKSAEEVRRYYELLEEDVKRIEAGKVPFPVYRCPPAPPPITS

SEQ ID NO: 410 - DNA, 563 bp, Musa acuminata
  misc_feature: Ceres Clone ID no. 1723374
  misc_feature: Encodes the peptide sequence at SEQ ID NO. 411
acacagatcagctagctccaccagagaagcaaagcaaacccttcttccctgagatggcatccggttcgatgagctcctcctggaccgcgaaggagaacaagatgttcgagaaggcactggcggtgtacgacagggacacccccgaccgctggcacaagatcgcccgggccatcggcgggaagacggcggacgaagtgaagcgctactacgacctgctcgtggaggacgtgcgccgcatcgaggctggccaaatgccgtacgccaattaccggtcctctaatggcagaggttgagagtgtttggagctcaaccggagaacgaacaagaagcaaggagcatttcactgttctggatatcagttaccacaatcttaattataggactatatgaactctacatgtctgtggacttacaagtagtttcttctatgcagtcttctttctcccttctatcgtgtactcccagatatatcgaagactgccatcataaacatatatatggctagtcttcttgtaatcggttatcttgcttgctaatgaacgcttagtattgttctattctag

SEQ ID NO: 411 - protein, 79 aa, Musa acuminata
  misc_feature (7)..(56): Pfam Name: Myb_DNA-binding Pfam Description: Myb-like DNA-binding domain
  misc_feature: Ceres Clone ID no. 1723374
  misc_feature: Bit score of 122.5 for HMM based on sequences of Figure 7
  misc_feature: Functional Homolog Of SEQ ID NO. 323
MASGSMSSSWTAKENKMFEKALAVYDRDTPDRWHKIARAIGGKTADEVKRYYDLLVEDVRRIEAGQMPYANYRSSNGRG

SEQ ID NO: 412 - DNA, 285 bp, Populus balsamifera subsp. trichocarpa
  misc_feature: Ceres Annot ID no. 1457230
  misc_feature: Encodes the peptide sequence at SEQ ID NO. 413
atggcatcaagttctttcccgcagcccagcacaaattggtcagccgaacaaaacaagttgttcgaaaatgctcttgcgatatatgataaggacactccggatcgttgggggaaaatagccaagattgtcaaaggaacaaccgaggatgaagtaaagcagcaatacgagatccttcttgatgatataaagagcattgagtcggacaaagtcccgctaccgaattacaagaacgaaggaagcagcaaggaaaacatcatcggtaatgaagaggagaggctgcagtaa

SEQ ID NO: 413 - protein, 94 aa, Populus balsamifera subsp. trichocarpa
  misc_feature (10)..(59): Pfam Name: Myb_DNA-binding Pfam Description: Myb-like DNA-binding domain
  misc_feature: Ceres Annot ID no. 1457230
  misc_feature: Bit score of 124.4 for HMM based on sequences of Figure 7
  misc_feature: Functional Homolog Of SEQ ID NO. 323
MASSSFPQPSTNWSAEQNKLFENALAIYDKDTPDRWGKIAKIVKGTTEDEVKQQYEILLDDIKSIESDKVPLPNYKNEGSSKENIIGNEEERLQ

SEQ ID NO: 414 - DNA, 270 bp, Sorghum bicolor
  misc_feature: Ceres Annot ID no. 8667653
  misc_feature: Encodes the peptide sequence at SEQ ID NO. 415
atgtcgctgagctcgacgagggcgcagtggacggcgaagcagaacaagctgttcgagcaggcgctggcggtgtacgacagggacacgccggaccggtggcacaacatcgcgcgcgccgtcgggggcggcaagtcggcggacgaggtcaggcgctactacgagctgctggtgaaggacgtggagcacatcgaggccggcaaggtgcccttcccggcctacaggtgccccgccggctacgacgccgacaggctgaagcacctgaagatctag

SEQ ID NO: 415 - protein, 89 aa, Sorghum bicolor
  misc_feature (7)..(57): Pfam Name: Myb_DNA-binding Pfam Description: Myb-like DNA-binding domain
  misc_feature: Ceres Annot ID no. 8667653
  misc_feature: Bit score of 152.6 for HMM based on sequences of Figure 7
  misc_feature: Functional Homolog Of SEQ ID NO. 323
MSLSSTRAQWTAKQNKLFEQALAVYDRDTPDRWHNIARAVGGGKSADEVRRYYELLVKDVEHIEAGKVPFPAYRCPAGYDADRLKHLKI

SEQ ID NO: 416 - protein, 90 aa, Oryza sativa subsp. japonica
  misc_feature (6)..(56): Pfam Name: Myb_DNA-binding Pfam Description: Myb-like DNA-binding domain
  misc_feature: Public GI ID no. 115465643
  misc_feature: Bit score of 143.4 for HMM based on sequences of Figure 7
  misc_feature: Functional Homolog Of SEQ ID NO. 323
MAQQARAQWPQKQNKLFEQALAVYDKETPDRWHNIARAVGGGKSAEDVKRYYEMLEEDIKHIESGKVPFPAYRCPAAAGYQAERLKHLKI

SEQ ID NO: 417 - protein, 126 aa, Oryza sativa subsp. japonica
  misc_feature (24)..(74): Pfam Name: Myb_DNA-binding Pfam Description: Myb-like DNA-binding domain
  misc_feature: Public GI ID no. 5091605
  misc_feature: Bit score of 130.9 for HMM based on sequences of Figure 7
  misc_feature: Functional Homolog Of SEQ ID NO. 323
MASAAGSKQQQAMMSLPSSRGGGGGGWTQRQNKQFECALAVYDKETPDRWHNIARYMGGAKSADEVRRHFDHLVEDVSRIESGRVPFPRYSSSSSSRGADDGNRLLTVFHLSSVPRTRNANHKFNT

SEQ ID NO: 418 - protein, 111 aa, Oryza sativa subsp. indica
  misc_feature (24)..(74): Pfam Name: Myb_DNA-binding Pfam Description: Myb-like DNA-binding domain
  misc_feature: Public GI ID no. 125553458
  misc_feature: Bit score of 130.2 for HMM based on sequences of Figure 7
  misc_feature: Functional Homolog Of SEQ ID NO. 323
MASAAGSKQQQAMMSLPSSRGGGGGGWTQRQNKQFECALAVYDKETPDRWHNIARYMGGAKSADEVRRHFDHLVEDVARIESGRVPFPRYSSSSSSRGADDGNRSRYLKYQ

SEQ ID NO: 419 - DNA, 255 bp, Populus balsamifera subsp. trichocarpa
  misc_feature: Ceres Annot ID no. 1510435
  misc_feature: Encodes the peptide sequence at SEQ ID NO. 420
atggcatcaagttctttcccgcagcccagcacaaattggtcagccgaacaaaacaagttgttcgaaaatgctcttgcgatatatgataaggacactccggatcgttgggggaaaatagccaagattgtcaaaggaacaaccgaggatgaagtaaagcagcaatacgagatccttcttgatgatataaagagcattgagtcggacaaagtcccgctaccgaattacaagaacgaaggaagcagctgcagtaactaa

SEQ ID NO: 420 - protein, 84 aa, Populus balsamifera subsp. trichocarpa
  misc_feature (10)..(59): Pfam Name: Myb_DNA-binding Pfam Description: Myb-like DNA-binding domain
  misc_feature: Ceres Annot ID no. 1510435
  misc_feature: Bit score of 111.1 for HMM based on sequences of Figure 7
  misc_feature: Functional Homolog Of SEQ ID NO. 323
MASSSFPQPSTNWSAEQNKLFENALAIYDKDTPDRWGKIAKIVKGTTEDEVKQQYEILLDDIKSIESDKVPLPNYKNEGSSCSN

SEQ ID NO: 421 - protein, 85 aa, Oryza sativa subsp. japonica
  misc_feature (11)..(60): Pfam Name: Myb_DNA-binding Pfam Description: Myb-like DNA-binding domain
  misc_feature: Public GI ID no. 115438765
  misc_feature: Bit score of 125.0 for HMM based on sequences of Figure 7
  misc_feature: Functional Homolog Of SEQ ID NO. 323
MASMSVSSSRAPQWTARQNEQFERALAVYDRDTPERWHNIARAVAGKSADEVKLYYDLLVEDVKRIETGKVPFPAYRCPQPAIAG

SEQ ID NO: 422 - protein, 90 aa, Antirrhinum majus
  misc_feature (8)..(57): Pfam Name: Myb_DNA-binding Pfam Description: Myb-like DNA-binding domain
  misc_feature: Public GI ID no. 112292438
  misc_feature: Bit score of 121.1 for HMM based on sequences of Figure 7
  misc_feature: Functional Homolog Of SEQ ID NO. 323
MASSSMTSSSWTQKQNKQFEEALAMYGNDTPDCWQNIARKVGGKSAEEIRRHYEVLVKEIMKIETDQVPIPNYNKVKGSNSRGYGNYRGF

SEQ ID NO: 423 - DNA, 330 bp, Oryza sativa
  misc_feature: Ceres Annot ID no. 1770841
  misc_feature: Encodes the peptide sequence at SEQ ID NO. 424
atgagttcatcatggacgacgaagcagaacaagctgttcgagagggcgctggcgacatacgacaaagacacgccgggccgctggcagaacgtggcgcgggcagtgggtggtggaaagacggccgaggaggtgaagaggcactacgacaagctgcttcaagacctgcaccacattgagtcggcaggccgtcagggttcccaatacggcggcagcagcagcagcaaatccaaaggtggcagcagcagcggggagcagagatatcggaacagagactggaagcagcaaccagggctccatagtggtgccgtgaaaagagcctctcagtattag

SEQ ID NO: 424 - protein, 109 aa, Oryza sativa
  misc_feature (2)..(52): Pfam Name: Myb_DNA-binding Pfam Description: Myb-like DNA-binding domain
  misc_feature: Ceres Annot ID no. 1770841
  misc_feature: Bit score of 105.1 for HMM based on sequences of Figure 7
  misc_feature: Functional Homolog Of SEQ ID NO. 323
MSSSWTTKQNKLFERALATYDKDTPGRWQNVARAVGGGKTAEEVKRHYDKLLQDLHHIESAGRQGSQYGGSSSSKSKGGSSSGEQRYRNRDWKQQPGLHSGAVKRASQY

SEQ ID NO: 425 - DNA, 2145 bp, Arabidopsis thaliana
  misc_feature: Ceres Annot ID no. 878355
  misc_feature: Encodes the peptide sequence at SEQ ID NO. 426
actctcaatatcactattaaatatctttctcttttcacttcttcactttcctcgattcctgagttttcgatccttttgttctctaaccaccggtttcctctttaaccggtctctggataatcatcataatcattaggatcatcaagataaggaatctttttgagtatatctctacaccaaatcgaatctatggatcaaaaagttagacagtttgaggtttgcactcaagacggtagcgttgatcgtcacggcaatccagctatccgagctaataccggcaaatggctcactgctattctcattctagtgaatcaaggactagctacgcttgcgttcttcggtgtaggagtgaatttggttctgtttctgactcgagtgatgggacaagacaatgcagaagcggctaataatgttagtaaatggacaggaactgtctatatcttctctttgcttggtgctttcctcagtgactcttattggggacgttacaagacttgtgctatctttcaagcaagtttcgttgcagggttgatgatgttatctttatctactggtgcgttattgcttgaaccaagtggttgtggagttgaagattcgccgtgtaagcctcattcgacgtttaagacggttctgttttatctgtcggtgtatctaatcgcgttagggtatggtggttatcagccgaacatagctacttttggagctgatcagtttgatgcggaggattccgttgaaggacactcgaaaatcgcgtttttcagttacttttacttggctctgaatcttggatcgctcttctcaaatactgtcttgggttactttgaggatcaaggggaatggccgcttggattttgggcgtctgctggctctgcttttgcggggttagtgcttttcttgattggcacgccaaagtaccgacactttacgcctagagagagtccttggtctagattctgccaagtgttggttgctgcaacaagaaaggctaagattgatgtgcaccatgaagagttgaatctctatgattctgagactcaatacactggagataagaagattcttcataccaaaggcttcagattcttggatagagctgctattgttacacctgatgatgaggctgagaaagtagagagcggatcgaaatacgatccatggaggctctgctcggtgactcaagtcgaagaagtgaaatgtgtattaagactcttaccaatctggctctgcaccatcctctactctgtggttttcacccaaatggcttcactgttcgttgtgcaaggagcagcgatgaagacaaacatcaaaaacttccggattccagcttcaagcatgtctagtttcgacattctcagtgtcgccttcttcatcttcgcatacaggcggtttcttgatccactctttgcaagacttaacaaaacagaacgcaacaaaggtctcactgagcttcagaggatggggattgggcttgtgattgcgataatggcgatgatttccgcaggaatcgtagagatacacagactgaaaaataaggaaccggaaagtgctacttcgatctcaagctccagcactttgagcattttttggcaagtacctcagtacatgttgataggtgcatcagaagtgttcatgtacgttggtcaactcgagttcttcaacagccaagcaccaaccgggctaaagagctttgcaagcgcgctatgtatggcttcaatatctcttgggaactatgtaagcagtttgttagtttccattgtcatgaagatctctacaacagatgatgtgcatggctggattcctgaaaatctcaacaaaggacacttggagagattctacttccttttagctggtctaaccgctgctgatttcgtggtttacttgatttgtgccaaatggtacaagtatattaaatctgaagcaagtttctctgagtccgtaactgaagaggaggaagtctgagtcaggagctagagagttttgtgttttattttaatgctgtgaagctttttacagtaatttgtttaaagctgagcttgttctgtgatataaactggtcttattgtgtttttatttttgggttatactcttgtgcaaagtttagttgatgtttctcaataaaggataagttgattccacagttccaac

SEQ ID NO: 426 - protein, 589 aa, Arabidopsis thaliana
  misc_feature (100)..(509): Pfam Name: PTR2 Pfam Description: POT family
  misc_feature: Ceres Annot ID no. 878355
  misc_feature: Bit score of 1309.7 for HMM based on sequences of Figure 11
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 427 - DNA, 1821 bp, Populus balsamifera subsp. trichocarpa
  misc_feature: Ceres Annot ID no. 1472338
  misc_feature: Encodes the peptide sequence at SEQ ID NO. 428
atggcctgcttaaatatttgcaaagaggaaggaagcgtgcaggggaagctcgtgaagaaggagcaggaggtttgcactagggatggaagcgttgatcgacatggcgatcctgcaatccgggggaggactgggacttggttcgctggaatcctcatattagtgaatcaagggctggcgacgttggccttctttggggtaggagtgaacttggttctgtttttgacaagagtgttgggtcaagacaatgccgaagctgcaaacaacgtcagcaaatggactggaactgtttacatattctctcttctcggcgccttcctcagcgactcttactgggggaggtacaagacttgtgctatcttccaggccatcttcgtcactggtctggtattgttgtcactgtcttcctacttattcttactcaaaccgagaggctgtggtgatgaacattctccatgtggatcccattcaacataccagaatgtctttttctacttctccatctatcttgttgcccttggaaatggaggctaccagcctaacattgctacctttggggctgatcagtttgatgaagaggaccctaaagaaggccactctaagatagctttctttagctacttttacttggctctcaaccttggttctctcttttcgaacaccatattgggctattttgaggaccggggcatgtgggcgttaggattctgggcatctgctggctctgctcttttggcactggtcttgtttctcattgggactcccaggtatagacacttcacccccaagggcaaccccctctctaggtgttgccaggtgatggttgctgcaacaagaaaatggaaggttcagaggatgccaaatcaaggtgatgatcagtttgaatcggatgtcccaaaggacggttccaaaaatggggatagaaagatactacacacccaaggattcagattcttggatagagctgcaattattacatccaaggattatacagagaatcgcattcacgatccatggcgtgtctgcacagtaaatcaagttgaagaatttaaatgcatcctacgactcctccctatctggctgtgcacaattctttactctgtagttttcactcaaatggcatcactcttcgtcgaacaaggtgctgatatgaaaactacgatttcgaaattccacattcctccagcaagcatgtctagtttcgacatactcagtgttgcggctttcatattcatctataggagagttcttgatccccttgttgccagaataagaaaggaccctaagggcctgacagagcttcagaggatggggattggtctagttatcgcaataattgcaatggtttcggcagggattgtagagctattcaggttgaagtacgcaagaaaagactgtccaagatgcgaaagtgcgagttctttgagcatactttggcaaattcctcaatatgttctgataggagcatctgaggtgttcatgtatgtggggcaattagaattcttcaatgggcaagcacctgatggattgaagagcttcggcagtgcactttgcatgacatcaatatctctaggcaactatgtgagtagcttgctagtaacagtcgtaatgaagatatctaccagagatgagatgccaggatggatcccaggaaaccttaacaagggtcatctagacagatttttcttcctcttggcagttttgacaaccgcagatcttgttctgtacattatctgtgctagatggtacaagtacatcaagtttgagaggcagcaggaagcggatagtatattaagcaatgaagaggcagaccttagagtttga

SEQ ID NO: 428 - protein, 606 aa, Populus balsamifera subsp. trichocarpa
  misc_feature (114)..(521): Pfam Name: PTR2 Pfam Description: POT family
  misc_feature: Ceres Annot ID no. 1472338
  misc_feature: Bit score of 1378.9 for HMM based on sequences of Figure 11
  misc_feature: Functional Homolog Of SEQ ID NO. 426
MACLNICKEEGSVQGKLVKKEQEVCTRDGSVDRHGDPAIRGRTGTWFAGILILVNQGLATLAFFGVGVNLVLFLTRVLGQDNAEAANNVSKWTGTVYIFSLLGAFLSDSYWGRYKTCAIFQAIFVTGLVLLSLSSYLFLLKPRGCGDEHSPCGSHSTYQNVFFYFSIYLVALGNGGYQPNIATFGADQFDEEDPKEGHSKIAFFSYFYLALNLGSLFSNTILGYFEDRGMWALGFWASAGSALLALVLFLIGTPRYRHFTPKGNPLSRCCQVMVAATRKWKVQRMPNQGDDQFESDVPKDGSKNGDRKILHTQGFRFLDRAAIITSKDYTENRIHDPWRVCTVNQVEEFKCILRLLPIWLCTILYSVVFTQMASLFVEQGADMKTTISKFHIPPASMSSFDILSVAAFIFIYRRVLDPLVARIRKDPKGLTELQRMGIGLVIAIIAMVSAGIVELFRLKYARKDCPRCESASSLSILWQIPQYVLIGASEVFMYVGQLEFFNGQAPDGLKSFGSALCMTSISLGNYVSSLLVTVVMKISTRDEMPGWIPGNLNKGHLDRFFFLLAVLTTADLVLYIICARWYKYIKFERQQEADSILSNEEADLRV

SEQ ID NO: 429 - protein, 589 aa, Vitis vinifera
  misc_feature (98)..(506): Pfam Name: PTR2 Pfam Description: POT family
  misc_feature: Public GI ID no. 157344683
  misc_feature: Bit score of 1376.7 for HMM based on sequences of Figure 11
  misc_feature: Functional Homolog Of SEQ ID NO. 426
MYLNPLSECTFDGSVDRHGHPAVRARTGNWVTAILILVNQGLATLAFFGVGVNLVLFLTRVLGQDNATAANNVSKWTGTVYIFSLLGAFLSDSYWGRYKTCAIFQVIFVIGLVLLSLSSYIFLLKPNGCGDKEFPCGSHSTFEISFFYLSIYLIALGNGGYQPNIATFGADQFDEDNPKESHSKVAFFSYFYLALNLGSLFSNTILGYFEDGGRWVLGFWASSASAILALILFLFGIPRYRHFKPSGNPLSRFCRVVVAATRKWKVEMPPEGEDLYEVDGDDCSGNCRRKMLHTQGFKFLDKAAVLTAKEREQEDKESRSPWRICTVTQVEEVKCILRLLPIWLCTILYSVVFTQMASLFVEQGAAMKTTLLGFHIPPASMSSFDIVSVAAFIFIYRRVLDPLVARLKGTKARGLTELQRMGIGLIIAIIAMVAAGIVEWFRLKYAKKDCRQCESESSLSIFWQIPQYVLIGASEVFMYVGQLEFFNDQAPDGLKSFGSALCMTSISLGNYVSSLLVTIVMKFSTRDQMPGWIPSNLNKGHLDRFYFLLAALTMADFGVYIICAKWYKSIKLEGKYEDSNSKGSDDVMV

SEQ ID NO: 430 - protein, 589 aa, Medicago truncatula
  misc_feature (98)..(506): Pfam Name: PTR2 Pfam Description: POT family
  misc_feature: Public GI ID no. 87240677
  misc_feature: Bit score of 1329.2 for HMM based on sequences of Figure 11
  misc_feature: Functional Homolog Of SEQ ID NO. 426
MVNKELEVCTLDGSIDSHGHPAVRERTGTWFAGILILVNQGLATLAFFGVGVNLVLFLTRVMGQDNADAANNVSKWTGTVYIFSLLGAFLSDSYWGRYITCAIFQVIFVVGLVALSLTSYIFLLKPNGCGSKELPCGTHSSYETTLFYVSIYLVALGNGGYQPTIATFGADQFDESDPSEQHSKIAFFSYFYLALNIGSLFSNTILDYFEDDGLWTLGFCVSAGSAALALVLFLCGTSKYRYFKPVGNPLPRFCQVFVAAIRKWKVQMFDGEDKLHEVEDCLSNGGRKMYHTQGFRFLDKAAFITPKDLKQMEENKCSPWFLSTVTQVEEVKCILRLLPIWLCTILFSVVFSQMASLFVEQGAAMETKISTFHIPPASMSSFDILSVVSFIFIYRRILDPLVARFTKKSKGITELQRMGIGLVLAIIAMVSAGLVEIFRLKYAIKEEKNCSHCEGTSSLSIFWQVPQYVLIGASEVFMYVGQLEFFNSQAPDGLKSFGSALCMTSISLGNYVSSLLVAIVMKISTRNEGMLGWIPGNLNMGHLDRFYFLLAALTAADLLVYIAMARWYKYVKFHGNNIEQGNNIEENVV

SEQ ID NO: 431 - protein, 584 aa, Oryza sativa subsp. japonica
  misc_feature (103)..(504): Pfam Name: PTR2 Pfam Description: POT family
  misc_feature: Public GI ID no. 115448297
  misc_feature: Bit score of 1337.7 for HMM based on sequences of Figure 11
  misc_feature: Functional Homolog Of SEQ ID NO. 426
MAPTAVDSKRISDITEDGSMDRRGNPAVKAKTGNWRSSILLLVNYGLVTCAFFGVGVNLVVFLRRVLHQDNAEAANSISKWTGTVYIFSLIGAFMSDSYWGRYITCAIFQMIYVTGLVILSLASWFLLVKPTGCGAAGEHCDAPSSAGVALFYLSTYMIAFGNGGYQPSIATFGSDQFDETDPREARSKVAFFSYFYLALNVGSLFSNTVLVYYEDEGRWVMGFWVSAAAAAMALVLFLLGTPNYRHFKPTGNPLTRIAQVFVAAFRKWRAEVPRSELLHEVDGDESQIAGIRKILHSDQIRFLDKAATVTEEDYCTPENMQDPWRLCTVTQVEEVKCILKMLPIWLCTIVYSVVFTQMASLFVEQGTTMNTNIGSFHVPAASMSVFDILSVLAFIAIYRRVLVPVMSRLSGNPQGLTELQRMGVGLVVGMAAMVVAGVVEVERLKRVGAPDQPSSLSVLWQVPQYALIGASEVFMYVGQLEFFNGQAPDGVKSFGSSLCMASISLGNYVSIMLVSVVTSLTAGDRRPGWIPGNLNSGHLDRFYFLLAALSLVDLAVYVACAVWYKGIKLDSNEEKANKITVHV

SEQ ID NO: 432 - DNA, 2233 bp, Panicum virgatum
  misc_feature: Ceres Clone ID no. 1844568
  misc_feature: Encodes the peptide sequence at SEQ ID NO. 433
gcatgttcagctgttacactttcgcaatggataaccctgttcatccctagctaacacgaggtcttatatatcacaggctaaatcttgctggcaatacgatctttcaacttctccttacagcaagactgaagaaattcctgaacaagctgcggagaacagattaagcaagcaaggctgatagtgaagtttcagaaagctcattgaacgacgtgatggatcccaccactgttgaatcgaaatgggtgtctcccaccactgaagatgggtcaatggacaggagaggaaacccagctgccaaagcagcatctggaagatggagatctgccatcctgctgctcgccaactacgggctcgtgacgtgcgccttcttcggcgtcggtgtgaacctggtggtgttcctgcggcgggtgctccaccaggacaacgccgaggcggccaacaacatcagcaagtggaccggcaccgtctacatcttctcgctcatcggcgccttcctcagcgactcctactggggccgttacgtcacctgcgccatcttccagatcatctacgtgacgggcctggtgattctgtcgcttgcgtcatggttcttgctggtgaagccctccggctgcggcggcgtcgatgcgcgctgcgacgagccgtcggcgcccggcgtcgcgctcttctacctgtccacctacatgatcgcgttcggcaacggcgggtaccagccttcgatcgccacgttcgggtcggaccagttcgacgagacggaccccaaggaggcgcgctccaaggtcgccttcttcagctacttctacctggcgctcaacgtcgggtccctcttctccaacacggtgctggtgtactacgaggactcgggccgctgggtcatggggttctgggtctcggcggccgccgcggcgctggcgctcgtgctcttcctgctcggcacccccaactaccggcacttcaagccgagcggcaacccgctgacgcgcgtcgcgcaggtgttcgtcgccgcgctccgcaagtggcacgcggaggtgccccgagaagagttcctccacgaggtggaaggagaggaccccaaggtctcgggcatccgcaagatccttcacagcgacgagctcaggttcctcgacagggcggcgacggtcaccgaggaggagtacggcgcgccggagaagatgaaggacccgtggcggctctgcacggtgacgcaggtggaggaggtgaagtgcatcctgaagatgctgcccatctggctgtgcacgatcgtgtactcggtggtgttcacccagatggcgtccctgttcgtggagcagggcgccaccatgaacaccaacatcgggtcgttccacttccccgccgcgagcatgtcgctgttcgacatcctcagcgtgctggcgttcatcgccatctaccgccgcgtgctggtccccgtgatggcgcggctgtcgggcaacccgcagggcctgacggagctgcagcgcatgggcgtggggctcgtgatcggcatggcggccatggtggtggcgggcgcggtggaggtggagcggctgcggcgcgtggcggccccggaccagccgagctcgctgagcgtgctgtggcaggtgccgcagtacgcgctgatcggggcgtcggaggtgttcatgtacgtggggcagctggagttcttcaacgggcaggcccccgacggcgtgaagagcttcggcagcgcgctgtgcatggcgtccatctcgctggggaactacgtgagcatcatgctggtgagcgtggtcaccagcctcaccgccggggagaggcggcccgggtggatcccggggaacctcaactccggccacctcgacaggttctacttcctcctcgccgcgctctcgctagtggacctcgccgtgtacgtcgcgtgcgcgacgtggtacaagggcatcaagctcgatggcggcggcgagacgaggaagaaccccgcgcacgtttaaacactgggcctgggccgttcttttgggtgttctggtttggagacgtgccgtgctggcccgtagaaaataaaatgtcaaagaactggcatgtggtccgtgttggatggcctattttgttctgtgtctttggtctagctccaagaatcagtctcagaactccatgtaatgctgctatgtatgtaaatataataaatatagtatatgtatggatgtctgctgaacttgcatgcagccaacctgtcaaagacagacttttttgtgtgtgatcg

SEQ ID NO: 433 - protein, 583 aa, Panicum virgatum
  misc_feature (103)..(504): Pfam Name: PTR2 Pfam Description: POT family
  misc_feature: Ceres Clone ID no. 1844568
  misc_feature: Bit score of 1338.2 for HMM based on sequences of Figure 11
  misc_feature: Functional Homolog Of SEQ ID NO. 426
MDPTTVESKWVSPTTEDGSMDRRGNPAAKAASGRWRSAILLLANYGLVTCAFFGVGVNLVVFLRRVLHQDNAEAANNISKWTGTVYIFSLIGAFLSDSYWGRYVTCAIFQIIYVTGLVILSLASWFLLVKPSGCGGVDARCDEPSAPGVALFYLSTYMIAFGNGGYQPSIATFGSDQFDETDPKEARSKVAFFSYFYLALNVGSLFSNTVLVYYEDSGRWVMGFWVSAAAAALALVLFLLGTPNYRHFKPSGNPLTRVAQVFVAALRKWHAEVPREEFLHEVEGEDPKVSGIRKILHSDELRFLDRAATVTEEEYGAPEKMKDPWRLCTVTQVEEVKCILKMLPIWLCTIVYSVVFTQMASLFVEQGATMNTNIGSFHFPAASMSLFDILSVLAFIAIYRRVLVPVMARLSGNPQGLTELQRMGVGLVIGMAAMVVAGAVEVERLRRVAAPDQPSSLSVLWQVPQYALIGASEVFMYVGQLEFFNGQAPDGVKSFGSALCMASISLGNYVSIMLVSVVTSLTAGERRPGWIPGNLNSGHLDRFYFLLAALSLVDLAVYVACATWYKGIKLDGGGETRKNPAHV

SEQ ID NO: 434 - DNA, 2101 bp, Triticum aestivum
  misc_feature: Ceres Clone ID no. 797829
  misc_feature: Encodes the peptide sequence at SEQ ID NO. 435
tacggagtgacagatacagaccgggcgtgcgagggagggaggaagggagctcggaggaagcagagggatcccatccgctccggcggtgccaggaagctgttcctctgagccgctgcagcgcgtagcctgactgagcagcgagagacaagcagcaaggtcagcagccatgggggaggtcgcggcggagctgtacacccaggatggcaccatcgacatcaagggcaacccggccctcaagaaggacaccggcaactggcgcgcatgcccctacatcctcgcgaacgagtgctgcgagcggctggcctattacggcatgagcaccaacctcgtcaacttcatgaaggaccggatgggcatggccaacgccgccgccgccaacaacgtcaccaactggggcggcacctgctacatcacgccgctcatcggcgccttcctcgccgacgcctacctcggccgcttctggaccatcgcctccttcatgatcatctacatcttcggcctcggcctgctcaccatggccacctccgtgcacggcctcgtgcccgcctgcgcctccaagggcgtctgcgaccccacgccgggccagtcggcggcggtcttcatcgcgctctacctcatcgcgctcggcaccggcgggatcaagccatgcgtgtcgtcgttcggggccgaccagttcgacgagcacgacgacgtggagcgcaagagcaagagctcgtttttcaattggttctacttctccatcaacatcggcgcgctggtggcctcgtccgtcctggtgtacgtgcagacgcatgtcgggtggagctggggcttcggcatccccgccgtcgtcatggccatcgccgtcggcagcttcttcgtcggcacgccgctctacaggcaccagcgccccggcggcagcccgctcacccgcatcgcgcaggtgctcgtcgccgccacgcgcaagctcggcgtccccgtcgacgggtcggcgctgtacgagaccgcggacagggagtccggcatcgagggcagccgcaagctggagcacacggagcagttcaggttcctcgacaaggcggccgtggagacgcaggcggacaagacggccaccgggccgtcgccgtggcggctgtgcacggtgacgcaggtggaggagctcaagagcgtggtgcggctgctgcccatctgggcgagcggcatcgtcttcgccacggtgtacgggcagatgagcaccatgttcgtgctgcagggcaacaccctggacgcctccatggggcccaagttcaagatcccctccgcctccctctccatcttcgacaccctcagcgtcatcgcctgggtgcccgtctacgaccgcatcctcgtccccgccgtgcgctccgtcaccggccggccccgcggcttcacccagctccagcgcatgggcatcggcctcgtcgtctccatgttcgccatgctcgccgccggcgtgctcgagctcgttcgcctccgcaccatcgcgcagcgcggcctctacggggagcacgacgtcgtgcccatctccatcttctggcaggtgccgcagtacttcatcatcggcgccgccgaggtgttcaccttcgtgggccagctcgagttcttctacgaccaggcgcccgacgccatgaggagcatgtgctccgcgctctccctcaccaccgtcgccctcgggaactacctcagcacgctcctcgtcaccgtcgtggccaagctcaccaccaggggaggcaagcaagggtggatccccgacaacctcaacgtcggccacctcgactacttcttctggctgctcgccgccctcagcctcctcaacttcgccgtctacctcctcatcgccagctggtacacctacaagaagaccgccggagatgatcacccagacgccatagccaaagggggagctcatgattgatgcacatgaccagtaaataagtgagtgactatgtctgcggttggtgtatgaatgttgaaagcagaagaagaaagcaaggattgagagttcggataggtgaaattaagggaggacaatgaaatgcatggtgtgatttgtgacttcaagattcaggagtgctgccttgttgattaatatactagtgtcttg

SEQ ID NO: 435 - protein, 581 aa, Triticum aestivum
  misc_feature (98)..(499): Pfam Name: PTR2 Pfam Description: POT family
  misc_feature: Ceres Clone ID no. 797829
  misc_feature: Bit score of 1242.8 for HMM based on sequences of Figure 11
  misc_feature: Functional Homolog Of SEQ ID NO. 426
MGEVAAELYTQDGTIDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVPVDGSALYETADRESGIEGSRKLEHTEQFRFLDKAAVETQADKTATGPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQRGLYGEHDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDHPDAIAKGGAHD

SEQ ID NO: 436 - protein, 591 aa, Physcomitrella patens subsp. patens
  misc_feature (101)..(507): Pfam Name: PTR2 Pfam Description: POT family
  misc_feature: Public GI ID no. 168033816
  misc_feature: Bit score of 1251.7 for HMM based on sequences of Figure 11
  misc_feature: Functional Homolog Of SEQ ID NO. 426
MNAVGGAPDSEYPQDGTVDLRGNPVLKANTGGWKACPYILGNECCERLAYYGIATNLVTYLSHELHQNPSTAANNVTNWSGTCYITTLIGAFLADAYLGRFWTIVVFSIIYFLGMVLLTLSAALPSLKPPSGEGVVASSTQLAVFYLALYLIALGTGGIKPCVSSFGADQFDENDVKEKKRKSSFFNWFYFTINIGALIASSALVYIQENVGWGWGFGIPAVAMGIAIVSFLIGSPLYRHQKPGGSPITRIAQVLVAATRKLSMKVQPNGKHLYEADDKESGIEGSRKLEHTEEFRFLDKAAIPRGDEELQGTRPSGWRLTSVTQVEEVKIVMRLLPIWASGIVFATVYSQMSTMFVQQGALMNVSMGKANIPSASLSIFDTISVIVCVVIYDRFLVPVVRKRTGHVRGFTQLQRMGIGLFISVLAMVVAAIVEIERLKLARRDGVAGNPQDEALPVESLTIFVQIPQYFLIGAAEVFTFVGQLEFFYDQAPDAMRSLMSALSLTTVALGNYLSSVLVTIVTEVTTKGGKPGWIPNNLNRGHLDYFFWMLAILSILNIIFYLVVAKFYTYKRVHNAADVGEDGKPSKSGYE

SEQ ID NO: 437 - protein, 594 aa, Picea sitchensis
  misc_feature (121)..(527): Pfam Name: PTR2 Pfam Description: POT family
  misc_feature: Public GI ID no. 116788004
  misc_feature: Bit score of 1291.6 for HMM based on sequences of Figure 11
  misc_feature: Functional Homolog Of SEQ ID NO. 426
MGVEGEGSVETALLEEGSISSVQTGKASEDEYTGDGSVDFWGRPSVKENTGNWRACPFILGNECCERLAYYGINTNLVTYLTKRLHQGNAAAAKSVTTWAGTCYLTPLFGAVLADAYWGRYWTIAAFSTIYFIGMATLTLSASVSSLKPPSCIGSDCPTANLAQYGVFFLGLYLIALGTGGIKPCVSSFGADQFDDTDPKEKKKKGSFFNWFYFSINVGALVSSSVLVWVQDNVGWGWGFGIPTLFMGLAIGSFFSGTPLYRLQKPGGSPVTRMCQVVVASLRKLRKTVPLDHSHLYEVQDRNSAIQGSRKLEHTDEFKCLDKSAIITDDDVRKGGFSNPWRLCTVTQVEEMKILLRMFPIWATGIVFAAVYSQISTMFVEQGMTLDTSIGSRFHIPPASLSVFDVVSVMIWVPVYDRVIVPIVSKYTKRERGFTELQRMGIGLFISILAMVAAALVEIRRLNIVKTYDLVYDKGTPVPMSIFWQIPQYFLVGASEVFTFVGQLEFFYDQSPDAMRSLCSALSLLTTALGNYLSSLIVTIVMFATTKGGNIGWIPDNLNEGHLDYYFWVLASLSVLNLLVYVSCAHRYKYKKAS

SEQ ID NO: 438 - protein, 583 aa, Hakea actites
  misc_feature (112)..(516): Pfam Name: PTR2 Pfam Description: POT family
  misc_feature: Public GI ID no. 149900503
  misc_feature: Bit score of 1297.0 for HMM based on sequences of Figure 11
  misc_feature: Functional Homolog Of SEQ ID NO. 426
MGSLEERLLVEDEPVKNDGIGLYTGDGSVDIDGKPVLKENTGKWRACPFILGTECCERLAYYGIATNLVTYLTSKLHEGNASAARNVTTWSGTCYLAPLIGAVLADSYWGRYWTIAVFSIIYFIGMGTLTLSASVAAFKPSPCVGSVCPAATPAQYAVFFCGLYLIALGTGGIKPCVSSFGADQFDDTDPVERVQKGSFFNWFYFSINIGALISSSFLVWIQDNAGWGLGFGIPTLFMGVAIISFFSGTPLYRFQKPGGSPLMRMCQVFVASFRKWNLDVPQDSSLLFELPDKTSAIEGSRKLEHSDELRCLDKAAVVSDLDVQQGDLTNPWRLCTVTQVEELKILIRMFPIWATGIVFSAVYAQMSTMFVEQGMVLDTTIGSFTIPPASLSTFDVLSVIVWVPMYDRLLVPLARKFTGKERGFSELQRMGIGLFISILSMTAAAIVEIRRLQIAKSLGLVDQNVAVPMSILWQIPQYFLVGASEIFTFIGQLEFFYDQSPDAMRSLCSALSLLTTALGNYLSSFILTMVTTITTRGGKPGWIPDNLNEGHLDYFFWLLAGLSFLNLVIYVFCAARYKCKKAS

SEQ ID NO: 439 - protein, 580 aa, Solanum lycopersicum
  misc_feature (109)..(513): Pfam Name: PTR2 Pfam Description: POT family
  misc_feature: Public GI ID no. 4102839
  misc_feature: Bit score of 1292.5 for HMM based on sequences of Figure 11
  misc_feature: Functional Homolog Of SEQ ID NO. 426
MKYLFSKNGGLLEDENSGLYTRDGSVDIKGNPVLKSETGNWRACPFILGNECCERLAYYGIAANLVTYLTKKLHEGNVSAARNVTTWQGTCYITPLIGAVLADAYWGRYWTIATFSTIYFIGMCTLTLSASVPAFKPPQCVGSVCPSASPAQYAIFFFGLYLIALGTGGIKPCVSSFGADQFDDTDPKERVKKGSFFNWFYFSINIGALISSSLIVWIQENAGWGLGFGIPAVFMGIAIASFFFGTPLYRFQKPGGSPLTRMCQVLVAVFHKWNLSVPDDSTLLYETPDKSSAIEGSRKLLHTDELRCLDKAAVVSDNELTTGDYSNAWRLCTVTQVEELKILIRMFPIWATGIVFSAVYAQMSTMFVEQGMVMDTAVGSFKIPAASLSTFDTISVIVWVPVYDKILVPIARRFTGIERGFSELQRMGIGLFLSMLCMSAAAIVEIRRLQLARDLGLVDEAVSVPLSIFWQIPQYFILGAAEIFTFIGQLEFFYDQSPDAMRSLCSALSLLTTALGNYLSSFILTVVTSITTRGGKPGWIPNNLNGGHLDYFFWLLAALSFFNLVIYVFLCQMYKSKKAS

SEQ ID NO: 440 - protein, 584 aa, Vicia faba
  misc_feature (114)..(518): Pfam Name: PTR2 Pfam Description: POT family
  misc_feature: Public GI ID no. 31088360
  misc_feature: Bit score of 1269.8 for HMM based on sequences of Figure 11
  misc_feature: Functional Homolog Of SEQ ID NO. 426
MGSVEDDSSRLEEALIQDEESKLYTGDGSVDFKGRPVLKKNTGNWKACPFILGNECCERLAYYGIATNLVKPILLAKLHEGNVSAARNVTTWQGTCYLAPLIGAVLADSYWGRYWTIAIFSMIYFIGMGTLTLSASIPALKPAECLGAVCPPATPAQYAVFFIGLYLIALGTGGIKPCVSSFGADQFDDTDSRERVKKGSFFNWFYFSINIGALISSSFIVWIQENAGWGLGFGIPALFMGLAIGSFFLGTPLYRFQKPGGSPLTRMCQVVAASFRKRNLTVPEDSSLLYETPDKSSAIEGSRKLQHSDELRCLDRAAVISDDERKRGDYSNLWRLCTVTQVEELKILIRMFPVWATGIVFSAVYAQMSTMFVEQGTMMDTSVGSFKIPAASLSTFDVISVIFWVPVYDRFIVPIARKFTGKERGFSELQRMGIGLFISVLCMSAAAIVEIKRLQLAKELDLVDKAVPVPLTIFLQIPQYFLLGAAEVFTFVGQLEFFYDQSPDAMRSLCSALSLLTTSLGNYLSSFILTVVLYFTTRGGNPGWIPDNLNKGHLDYFSGLAGLSFLNMFLYIVAAKRYKSKKAS

SEQ ID NO: 441 - DNA, 1821 bp, Sorghum bicolor
  misc_feature: Ceres Annot ID no. 8681236
  misc_feature: Encodes the peptide sequence at SEQ ID NO. 442
atgaagatgagggcgatcgtcgtggaaggaggggagatgagcgcgccgacgccgacgccgaagcaggacaagtgctgcgagtacacgctcgacggctccgtcgacatcaagggccgcccggcggtcaaggggaaatcaggaggatggcttgccggtgctctaatccttgtgaaccagggcctggcgacactagccttcttcggcgtgaacgtgaacctggtgctgttcctgacgcgggtgctggggcagagcaacgaagacgccgccaacaacgtcagcaagtggacgggcaccgtgtacatgttctccctcatcggcgccttcctcagcgactcctactggggacgctacaagacctgcgccatcttccaggccatctttgtgctcggcctcgcgctgctgtcggtgtcgtcgcacctctacctaatcaggccggacgggtgcggcatggagcacgcgccctgcggcccgcactccggcaaggagctggggatcttctacatcgcgctgtacatgatcgccttcggcaacggcgggtaccagcccaacatcgccaccctgggcgccgaccagttcgacgaggacgaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccaccgcgctcctgcttttcctcagcgggacgctccggtatcgctatttccagcccggagggaacccgatcgggaggatttgccaggtcgccatcgccgcgtccaggaaatggaaggcgggcgcgtcgaccaccggagtggtcagcctgtacgagggcgacgagaaggcggatgccgccggtggcaggaagcttttgcacacgcaagggttcagtttcttggaccgcgcggcgcacgctgacacggactccaagctcggcgcgcgcgacccctggaagctgtgcacggtgacgcaggtggaggaggtcaagagcatcctgaggctcctccccatctggctctgcaccatcctctactcggtcgtcttcacccagatggcctcgctctttgtcgtgcagggcgccgcgatgcgccgcaccaccccgttctccggcttctccgtcccgccctccagcatgtcggccttcgacatcctcgccgtcgccaccacgatcttcttgtaccgccgcgccatctgcccgttcctggcgcggctcaccggccgcccggccggccccaccgagctgcagaggatgggcctcggcctggtcgtgggtgccctggccatggccacggccgggacggtcgagcacttccggaaggccagggccaccgcggcgatgagcagcgacctgcatatcatgtggcaggtgccgcagtacgcgctgatcggcgtgtcggaggtgatgatgtacgtcgggcagctcgagttcttcaacggccagatgcccgacgggctcaaaagcttcgggagcgcgctctgcatgatgtccatgtcgctcggcaactacttcagtgacgtcatcgtgagcgcggtcaccaggctcaccacgacgcgagggcggtccgggtggatcccggctgacctcaacgagggccacctcgacaagttctacttcctgctcgccgtgctggccgtcgcggacttcgcggtgtacctcgtgtgcgcgagccgctacgggagcggcaaggtggacgggaggagcagcgacgacgaggaggagggagcggccggtcaggtgacatccctgccggcttacgcatga

SEQ ID NO: 442 - protein, 606 aa, Sorghum bicolor
  misc_feature (117)..(517): Pfam Name: PTR2 Pfam Description: POT family
  misc_feature: Ceres Annot ID no. 8681236
  misc_feature: Bit score of 1256.2 for HMM based on sequences of Figure 11
  misc_feature: Functional Homolog Of SEQ ID NO. 426
MKMRAIVVEGGEMSAPTPTPKQDKCCEYTLDGSVDIKGRPAVKGKSGGWLAGALILVNQGLATLAFFGVNVNLVLFLTRVLGQSNEDAANNVSKWTGTVYMFSLIGAFLSDSYWGRYKTCAIFQAIFVLGLALLSVSSHLYLIRPDGCGMEHAPCGPHSGKELGIFYIALYMIAFGNGGYQPNIATLGADQFDEDDPAEAHSKVSFFSYFYLALNLGSLFSNTFLSYLEDKGSWALGFWASTAAAATALLLFLSGTLRYRYFQPGGNPIGRICQVAIAASRKWKAGASTTGVVSLYEGDEKADAAGGRKLLHTQGFSFLDRAAHADTDSKLGARDPWKLCTVTQVEEVKSILRLLPIWLCTILYSVVFTQMASLFVVQGAAMRRTTPFSGFSVPPSSMSAFDILAVATTIFLYRRAICPFLARLTGRPAGPTELQRMGLGLVVGALAMATAGTVEHFRKARATAAMSSDLHIMWQVPQYALIGVSEVMMYVGQLEFFNGQMPDGLKSFGSALCMMSMSLGNYFSDVIVSAVTRLTTTRGRSGWIPADLNEGHLDKFYFLLAVLAVADFAVYLVCASRYGSGKVDGRSSDDEEEGAAGQVTSLPAYA

SEQ ID NO: 443 - DNA, 1779 bp, Glycine max
  misc_feature: Ceres Annot ID no. 8519531
  misc_feature: Encodes the peptide sequence at SEQ ID NO. 444
atggaaccaggaatttgcaattctgtcaactccgtaaatgttgaagcaaccgagaaaaaggtgacaggaggaaatggaagctacacagagcagtcagacacaagctataagaagattaaaggaggttggaaaactgcaattatcttgttagcgaatcaagcactggctacactagctttctttggagttggagtgaacttggttctgtttctgacccgagtccttcgccaagacagtgctgaggctgctaacaatgtcagcaagtggaccggaactgtttacatattttcactcattggagccttcctcagtgattcttactggggacgatatttaacctgcgcaatctttcagttcatttttgttgtgggcttggggatgttgtcattgtcgtcttggcggtttttgatcaaaccggttggttgcggcaatgaagaaactacatgcttggaaccatcatcagtgggtgttggcattttctacttgtccatatatctagtggcatttggatatggagggcaccaacccaccttagcaacctttggtgcagatcaatttgacgagaagaacgaaaaacaaaagaacgcgagagaagctttcttctcttatttttactttgccctcaatgttggatctctgttctccaacactatattagtatactacgaggattcaggaatgtggacaatgggtttcttggtgtccttggcctcagctgttattgccttagtttcatacttagcaggatatcgaaaatatagatatgtaaagggatatgggaatccggtgataagggtagttcaggtgtttgtggccactgttagaaagtggaaggttggtccagccaaggaacaccaactttatgaggttgatggtccagaatctgccataaaagggagtagaaagattcatcacagcaatgattttagattcatggacaaggcagcaacaataacggagaaagatgcagttaatctcaagaatcactggcggctatgtactgtaactcaagttgaggaagccaaatgcgtactgagaatgctaccagtttggctatgtactataatttattcagttgtgtttacgcaaatggcttctctttttgtcgagcaaggggatgtgatgaacaacaagataggaaattttcacttgccagcagccagcatgtcagtgtttgatatctgcagtgtccttttatgcactggaatttatcgccaaatccttgttcctctagcaggaagatttagtggcaatcctaggggactaactgagcttcaaagaatgggagttggcctaattattggaatgttagctattcttgcagctggtgccacagagtttgaaaggctcaaacacattacacccggggaaaaggctagttctttgagtatattttggcaaatcccacagtatgttctagttggtgcttcagaagttttcatgtatgtgggtcaactggagttctttaatgggcaagccccagatggcataaaaagctttgggagctcactttgcatggcttcaatttctcttggaaactatgtgagtagcttgctggtgtacatggtgatgggaatcactgcaagaggcgagaatccgggatggattcccaataacttgaatgtggggcacatggataggtttttcttcctcgttgcagtgctaactgctcttgattttgtactctacttattatgtgctcgctggtacaagagcatcaaccttggagatggtgacatgggaagccaagaggacgaggaagtgatcagtaaagtttga

SEQ ID NO: 444 - protein, 592 aa, Glycine max
  misc_feature (111)..(509): Pfam Name: PTR2 Pfam Description: POT family
  misc_feature: Ceres Annot ID no. 8519531
  misc_feature: Bit score of 1264.8 for HMM based on sequences of Figure 11
  misc_feature: Functional Homolog Of SEQ ID NO. 426
MEPGICNSVNSVNVEATEKKVTGGNGSYTEQSDTSYKKIKGGWKTAIILLANQALATLAFFGVGVNLVLFLTRVLRQDSAEAANNVSKWTGTVYIFSLIGAFLSDSYWGRYLTCAIFQFIFVVGLGMLSLSSWRFLIKPVGCGNEETTCLEPSSVGVGIFYLSIYLVAFGYGGHQPTLATFGADQFDEKNEKQKNAREAFFSYFYFALNVGSLFSNTILVYYEDSGMWTMGFLVSLASAVIALVSYLAGYRKYRYVKGYGNPVIRVVQVFVATVRKWKVGPAKEHQLYEVDGPESAIKGSRKIHHSNDFRFMDKAATITEKDAVNLKNHWRLCTVTQVEEAKCVLRMLPVWLCTIIYSVVFTQMASLFVEQGDVMNNKIGNFHLPAASMSVFDICSVLLCTGIYRQILVPLAGRFSGNPRGLTELQRMGVGLIIGMLAILAAGATEFERLKHITPGEKASSLSIFWQIPQYVLVGASEVFMYVGQLEFFNGQAPDGIKSFGSSLCMASISLGNYVSSLLVYMVMGITARGENPGWIPNNLNVGHMDRFFFLVAVLTALDFVLYLLCARWYKSINLGDGDMGSQEDEEVISKV

SEQ ID NO: 445 - DNA, 1749 bp, Zea mays
  misc_feature: Ceres Annot ID no. 8631372
  misc_feature: Encodes the peptide sequence at SEQ ID NO. 446
atggatgctaccactgttgattccaaatggatctctcccgccactgaagatgggtccatggacaggcgaggaaacccagctgtcaagacaaccaccggaagatggagatctgccatcctgctgctagctaactatgggctcgcgacgtgcgccttcttcggcgtcggcgtgaacctcgtggtgttcctgcgccgggtgctccaccagggcaacgccgaggcggccaacagcatcagcaagtggactgggaccgtctacatcttctcgctcatcggcgccttcctcagcgactcctactggggccgatacgtcacgtgcgccgtcttccagatcatctacgtgatggggctggtggtcctgtcgctcgcgtcatggctcttgctggtgaagccgtccggctgcggcggcgtcaaggcgcactgcgacgggccgtcggcgcccggcgtcgcgctgttctacctgtccacctacatgatcgcgttcggcaacggagggtaccagccttccatcgcgacgttcgggtcggaccagttcgacgagacggaccccgaggaggcgcgctccaaggtggccttcttcagctacttctacctggcgctcaacgtcggctccctgctctccaacacggtgctggtgtactacgaggactcggggcggtgggtcatggggttctgggtctcggcggccgccgcggcgctggcgctcgtgctcttcctgctcggcacgcccggctaccgccacttcaagccgagcggcaacccgctcacccgcgtcgcgcaggtgttcgtcgccgcgctgcgcaagtggcgcgccgaggtcccgcgtggcgagctcctccacgaggtggtggaagcaggagaggaccctaaggtctcgggcatccgcaagatccttcacagcgacgggctcaggttcctcgacaaggcggcgacgatcacggaggaggaggaggaggagggtccgtggcggctctgcacggtgacgcaggtggaggaggtgaagtgcatcctgaggatgctgcccatctggctgtgcacgatcgtgtactcggtggtgttcacccagatggcgtcgctgttcgtggagcagggcgccaccatggacaccaacatcgggtcgttccacttccccgccgcgagcatgtcgctgttcgacgtcctcagcgtgctggcgttcatcgccatctaccggcgggtgctggtgcccgtcatggcgcggctgtcaggcaacccgcagggcctgaccgagctgcagcgcatgggcgtcgggctcgtgatcggcatggcggcgatggtggtggcgggcgtggtggaggtggagcggctgaagcgcgtggcggccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtagtcacgagcctcaccgccggtgagaagcgtccggggtggatccctgggaaccttaactcaggacacctcgacaggttctacttcctcctcgccgctctctcgctcgtggacctcgccgtctacgtcgcctgtgccatgtggtacaagggcatcaagcttgacggcggcgacggcgataacaggagaaaggtctctgcgcacgtctag

SEQ ID NO: 446 - protein, 582 aa, Zea mays
  misc_feature (103)..(501): Pfam Name: PTR2 Pfam Description: POT family
  misc_feature: Ceres Annot ID no. 8631372
  misc_feature: Bit score of 1317.4 for HMM based on sequences of Figure 11
  misc_feature: Functional Homolog Of SEQ ID NO. 426
MDATTVDSKWISPATEDGSMDRRGNPAVKTTTGRWRSAILLLANYGLATCAFFGVGVNLVVFLRRVLHQGNAEAANSISKWTGTVYIFSLIGAFLSDSYWGRYVTCAVFQIIYVMGLVVLSLASWLLLVKPSGCGGVKAHCDGPSAPGVALFYLSTYMIAFGNGGYQPSIATFGSDQFDETDPEEARSKVAFFSYFYLALNVGSLLSNTVLVYYEDSGRWVMGFWVSAAAAALALVLFLLGTPGYRHFKPSGNPLTRVAQVFVAALRKWRAEVPRGELLHEVVEAGEDPKVSGIRKILHSDGLRFLDKAATITEEEEEEGPWRLCTVTQVEEVKCILRMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYVACAMWYKGIKLDGGDGDNRRKVSAHV

SEQ ID NO: 447 - protein, 614 aa, Hordeum vulgare
  misc_feature (122)..(527): Pfam Name: PTR2 Pfam Description: POT family
  misc_feature: Public GI ID no. 151426449
  misc_feature: Bit score of 1253.5 for HMM based on sequences of Figure 11
  misc_feature: Functional Homolog Of SEQ ID NO. 426
MSANEGDLKMRVIAMGGEAASERRAAEEKLCEYTLDGSVDIKGRPAVKGKSGGWLAGGLILVNQGLATMAFFGVNVNLVLFLTRLVQQSNGDAANNVSKWTGTVYMFSLIGAFLSDSYWGRYKTCAIFQAIFVLGLGLLSLSSRLYLIRPVGCGTEHTPCASHSGTEMGIFYIALYMIAFGNGGYQPNIATFGADQFDEEDPAEAHSKVSFFSYFYMALNLGSLFSNTFLSYLQDHGKWVLGFWASTAAAATALLLFLSGTPQYRHAQPCGNPMASICQVASAACRNWKSGGVSPDVEILYEGDDKTDSGSRKLLHTKGFRFLDRAALTTEDTNSKLATCSKTRDQWRLCTVTQVEQVKSILRILPIWVCTILYSVVFTQMASLFVVQGAAMRRTTPLGSFSIPASSMSAFDILTVTTTIFLYRRAICPLLARLTGRPTGPTELQRMGLGLVLGAMAMANAGTVEHFRKASATTANGSELHILWQVPQYALIGVSEVMMYVGQLEFFNGEMPDGFKSFGSALCMMSMSLGNYFSDIIVSAVTKATAVDGRPGWIPADLNEGHLNKFYFLLAILSVADFAVYLVFAGRYRKSCKVEGRSDDEEEGSVDDEEACHA

SEQ ID NO: 448 - protein, 582 aa, Brassica rapa
  misc_feature (100)..(504): Pfam Name: PTR2 Pfam Description: POT family
  misc_feature: Public GI ID no. 192757675
  misc_feature: Bit score of 1309.3 for HMM based on sequences of Figure 11
  misc_feature: Functional Homolog Of SEQ ID NO. 426
MDQKVRHTEVCTQDGSVDRHGNPAIRAKTGKWLTAILILVNQGLATLAFFGVGVNLVLFLTRVMGQDNAEAANNVSKWTGTVYIFSLLGAFLSDSYWGRYKTCAIFQASFVAGLVMLSLSTGALLLEPSGCGVEESPCKPHSTVKTVIFYLSVYLIALGYGGYQPNIATFGSDQFDADDSVEGHSKIAFFSYFYLALNLGSLLSNTVLGYFEDQGAWPLGFWASAGSAFAGLVLFLAGTPKYRHFKPRESPWSRFCQVLVASTRKAKIDVNYDDMNLYDSETQRTGDKKILHTKGFRFLDRAAIVTPDDEAEKVESGSAYDPWRLCSVTQVEEVKCVLRLLPIWLCTILYSVVFTQMASLFVVQGAAMKTNIKDFRIPASSMSTFDILSVAFFIFAYRRFLDPLFARLNKTEPNKGLTELQRMGIGLVIAITAMISAGIVEIYRLKHKETASNSSSLSIFWQVPQYMMIGASEVFMYVGQLEFFNSQAPTGLKSFASALCMASISLGNYVSSLLVSIVMKISTRDDLPGWIPGNLNKGHLDRFYFLLAALTAADFVVYLVCAKWYKYIKSEASFSESIAEEE

SEQ ID NO: 449 - protein, 579 aa, Hordeum vulgare subsp. vulgare
  misc_feature (98)..(499): Pfam Name: PTR2 Pfam Description: POT family
  misc_feature: Public GI ID no. 2655098
  misc_feature: Bit score of 1231.9 for HMM based on sequences of Figure 11
  misc_feature: Functional Homolog Of SEQ ID NO. 426
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTSLYRHQRPGGSPLTRIAQVLVAATRKLGVAVDGSALYETADKESGIEGSRKLEHTRQFRFLDKAAVETHADRTAAAPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLAAGVLELVRLRTIAQHGLYGEKDVVPISIFWQVPQYFIIGCAEVFTFVGQLEFFYDQAPDAMRSMCSALSLTTVALGNYLSTLLVTVVAKVTTRGGKQGWIPDNLNVGHLDYFFWLLAALSLVNFAVYLLIASWYTYKKTAGDSPDAKGGAHDQ

SEQ ID NO: 450 - protein, 580 aa, Zea mays
  misc_feature (97)..(499): Pfam Name: PTR2 Pfam Description: POT family
  misc_feature: Public GI ID no. 194690746
  misc_feature: Bit score of 1197.4 for HMM based on sequences of Figure 11
  misc_feature: Functional Homolog Of SEQ ID NO. 426
MGEVEDMYTQDGTVDMKGNPAVKKGTGNWRACPYILANECCERLAYYGMSTNLVNYMKTRLGQVNSVASNNVTNWQGTCYITPLIGAFFADAYMGRFWTIAIFMIIYIFGLALLTMASSVKGLVPTSCGDKDVCHPTDAQAAVVFVALYLIALGTGGIKPCVSSFGADQFDENDEREKKSKSSFFNWFYFSINIGALVASTVLVYVQTHVGWGWGFGIPAVVMAIAVGSFFVGTPLYRHQKPGGSPLTRIAQVLVACARKWNVAVPADKSRLHETVDGESVIEGSRKLEHSEQLACLDRAAVVTAEDGAEASPWRLCSVTQVEELKSVIRLLPIWASGIVFAAVYSQMSTMFVLQGNTLDQSMGPRFKIPSATLSMVDTISVIVWVPVYDRAIVPLVRSYTGRPRGFTQLQRMGIGLVVSIFSMVAAGVLDIVRLRAIARHGLYGEDDIVPISIFWQIPQYFIIGCAEVFTFVGQLEFFYDQAPDAMRSMCSALSLTTVALGNYLSTVLVTIVTHITTRHGRIGWIPENLNRGHLDYFFWLLAVLSLLNFLAYLVIASWYKYKKTADDYPGAKGEHGTEH

SEQ ID NO: 451 - DNA, 2186 bp, Triticum aestivum
  misc_feature: Ceres Clone ID no. 752925
  misc_feature: Encodes the peptide sequence at SEQ ID NO. 452
aaaggtggctgtggctcacacacacacacacacacacgcagagacaagagacaagagacagcgagtcagaccaggccatagggaatcccgcgcgcggggcgggcgacgactgaggcggagatcccttccggccggccgccgccgctcgtggacaccgaccaacataggaagcagcagttcctctgagccgctgccgctgcagtgcctagtctgactgagcggcgagaaagaagcaaggccagcagccatgggggaggtcgcggcggagatgtacacccaggatggcaccgtcgacatcaagggcaacccggccctcaagaaggacaccggcaactggcgcgcatgcccctacatcctcgcgaacgagtgctgcgagcggctggcctactatggcatgagcaccaacctggtcaacttcatgaaggaccggatgggcatggccaacgccgccgccgccaacaacgtcaccaactggggcggcacctgctacatcacgccgctcatcggcgccttcctcgccgacgcctacctcggccgcttctggaccatcgcctccttcatgatcatctacatcttcggcctcggcctgctcaccatggccacctccgtgcacggcctcgtgccgacctgcgccgccaagggcgtctgcgaccccacgccgggccagtcggcggccgtcttcatcgcgctctacctcatcgcgctcggcaccggcgggatcaagccctgcgtgtcgtcgttcggggcggaccagttcgacgagcacgacgacgtggagcgcaagagcaagagctccttcttcaactggttctacttctccatcaacatcggcgcgctggtggcctcgtccgtgctcgtgtacgtgcagacgcatgtcggctggagctggggcttcggcatccccgccgtcgtcatggccatcgccgtcggcagcttcttcgtcggcacgccgctctacaggcaccagcgccccggcggcagcccgctcacccgcatcgcgcaggtgctcgtcgccgccacgcgcaagctcggcgtcaccgtcgacgggtcggcgctgtacgagaccgcggacagggagtccggcatcgaggggagccgcaagctggagcacactgagcagttgaggttcctcgacaaggcggccgtcgagacgcaggcggacaagacggcggccaccgggccgtcgccgtggcggctgtgcaccgtgacgcaggtggaggagctcaagagcgtggtgcggctgctgcccatctgggcgagcggcatcgtcttcgccacggtgtatgggcagatgagcaccatgttcgtgctccagggaaacaccctggacgcctccattgggcccaagttcaagatcccctccgcctcgctctccatcttcgacaccctcagcgtcatcgcctgggtgcccgtctacgaccgcctcctcgtccccgccgtgcgctccgtcaccggccagccccgcggcttcacgcagctccagcgcatgggcatcggcctcctcgtctccatgttcgccatgctcgccgccggcgtgctcgagctcgtccgcctccgcaccatcgcgcagcgcggcctctacggcgagaaggacgtggtgcccatctccatcttctggcaggtgccgcagtacttcatcatcggcgccgccgaggtcttcaccttcgtgggccagctcgagttcttctacgaccaggcgcccgacgccatgaggagcatgtgctccgcgctctccctcaccaccgtcgcgctcgggaactacctcagcacgctgctcgtcaccgtcgtggccaagctcaccaccaggggaggcaagcaagggtggatccccgacaacctcaacgtcggccacctcgactacttcttctggctgctcgccgcgctcagcctcctcaacttcgccgtctacctcctcatcgccagctggtacacctacaagaagaccgccggagatgacacagacgccaaagccaaaggaggcgctgatgattgatgcaaatgaccagtgagtgagtgactctgcctggggttggtgtatgaatgttgaaagaggaagaagaaagcaaggattgagacttcagagttcagataggtgaaattaagggaggacaatgaaatgcatggtgtgatttgtgacttgaagattcaagagtgttgccttgttgatttatatactagtgtcttgg

SEQ ID NO: 452 - protein, 581 aa, Triticum aestivum
  misc_feature (98)..(500): Pfam Name: PTR2 Pfam Description: POT family
  misc_feature: Ceres Clone ID no. 752925
  misc_feature: Bit score of 1236.7 for HMM based on sequences of Figure 11
  misc_feature: Functional Homolog Of SEQ ID NO. 426
MGEVAAEMYTQDGTVDIKGNPALKKDTGNWRACPYILANECCERLAYYGMSTNLVNFMKDRMGMANAAAANNVTNWGGTCYITPLIGAFLADAYLGRFWTIASFMIIYIFGLGLLTMATSVHGLVPTCAAKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVTVDGSALYETADRESGIEGSRKLEHTEQLRFLDKAAVETQADKTAATGPSPWRLCTVTQVEELKSVVRLLPIWASGIVFATVYGQMSTMFVLQGNTLDASIGPKFKIPSASLSIFDTLSVIAWVPVYDRLLVPAVRSVTGQPRGFTQLQRMGIGLLVSMFAMLAAGVLELVRLRTIAQRGLYGEKDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDTDAKAKGGADD

SEQ ID NO: 453 - protein, 574 aa, Oryza sativa subsp. indica
  misc_feature (103)..(494): Pfam Name: PTR2 Pfam Description: POT family
  misc_feature: Public GI ID no. 125540898
  misc_feature: Bit score of 1301.5 for HMM based on sequences of Figure 11
  misc_feature: Functional Homolog Of SEQ ID NO. 426
MAPTAVDSKRISDITEDGSMDRRGNPAVKAKTGNWRSSILLLVNYGLVTCAFFGVGVNLVVFLRRVLHQDNAEAANSISKWTGTVYIFSLIGAFMSDSYWGRYITCAIFQMIYVTGLVILSLASWFLLVKPTGCGAAGEHCDAPSSAGVALFYLSTYMIAFGNGGYQPSIATFGSDQFDETDPREARSKVAFFSYFYLALNVGSLFSNTVLVYYEDEGRWVMGFWVSAAAAAMALVLFLLGTPNYRHFKPTGNPLTRIAQVFVAAFRKWRAEVPRSELLHEVDGDESQIAGIRKILHSDQIRFLDKAATVTEEDYCTPENMQDPWRLCTVTQVEEVKCILKMLPIWLCTIVYSVVFTQMASLFVEQGTTMNTNIGSFHVPAASMSVFDILSVLAFIAIYRRVLVPGLTELQRMGVGLVVGMAAMVVAGVVEVERLKRVGAPDQPSSLSVLWQVPQYALIGASEVFMYVGQLEFFNGQAPDGVKSFGSSLCMASISLGNYVSIMLVSVVTSLTAGDRRPGWIPGNLNSGHLDRFYFLLAALSLVDLAVYVACAVWYKGIKLDSNEEKANKITVHV

SEQ ID NO: 454 - protein, 589 aa, Arabidopsis thaliana
  misc_feature (100)..(509): Pfam Name: PTR2 Pfam Description: POT family
  misc_feature: Public GI ID no. 26451333
  misc_feature: Bit score of 1306.0 for HMM based on sequences of Figure 11
  misc_feature: Functional Homolog Of SEQ ID NO. 426
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILNVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 455 - protein, 568 aa, Arabidopsis thaliana
  misc_feature (109)..(501): Pfam Name: PTR2 Pfam Description: POT family
  misc_feature: Public GI ID no. 2160144
  misc_feature: Bit score of 1035.6 for HMM based on sequences of Figure 11
  misc_feature: Functional Homolog Of SEQ ID NO. 426
MFKILTTKIQSFFCLNISGGTEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 456 - protein, 590 aa, Arabidopsis thaliana
  misc_feature (124)..(523): Pfam Name: PTR2 Pfam Description: POT family
  misc_feature: Public GI ID no. 30696666
  misc_feature: Bit score of 1070.9 for HMM based on sequences of Figure 11
  misc_feature: Functional Homolog Of SEQ ID NO. 426
MVNSNEEDERRILDVEESLLTQEEVNNHLTGLSSTAEDGSIDIYGNPPSKKKTGNWKACPFILGNECCERLAYYGIAKNLITYYTSELHESNVSAASDVMIWQGTCYITPLIGAVIADSYWGRYWTIASFSAIYFIGMALLTLSASLPVLKPAACAGVAAALCSPATTVQYAVFFTGLYLIALGTGGIKPCVSSFGADQFDDTDPRERVRKASFFNWFYFSINIGSFISSTLLVWVQENVGWGLGFLIPTVFMGVSIASFFIGTPLYRFQKPGGSPITRVCQVLVAAYRKLKLNLPEDISFLYETREKNSMIAGSRKIQHTDGYKFLDKAAVISEYESKSGAFSNPWKLCTVTQVEEVKTLIRMFPIWASGIVYSVLYSQISTLFVQQGRSMNRIIRSFEIPPASFGVFDTLIVLISIPIYDRFLVPFVRRFTGIPKGLTDLQRMGIGLFLSVLSIAAAAIVETVRLQLAQDFVAMSIFWQIPQYILMGIAEVFFFIGRVEFFYDESPDAMRSVCSALALLNTAVGSYLSSLILTLVAYFTALGGKDGWVPDDLNKGHLDYFFWLLVSLGLVNIPVYALICVKHTKKKAL

SEQ ID NO: 457 - protein, 561 aa, Oryza sativa subsp. indica
  misc_feature (91)..(486): Pfam Name: PTR2 Pfam Description: POT family
  misc_feature: Public GI ID no. 125556922
  misc_feature: Bit score of 1005.3 for HMM based on sequences of Figure 11
  misc_feature: Functional Homolog Of SEQ ID NO. 426
MEATTTDGTTDHAGKPAVRSKSGTACPFILGNECCERLAYYGMSANLVNYMVDRLRQGNAGAAASVNNWSGTCYVMPLVGAFLADAYLGRYRTIAAFMALYIVGLALLTMSASVPGMKPPNCATISASSCGPSPGQSAAFFVALYLIALGTGGIKPCVSSFGADQFDDADPREHRSKASFFNWFYMSINVGALVASSVLVWVQMNVGWGWGFGIPAVAMAVAVASFLMGSSLYRHQKPGGSPLTRMLQVVVAAARKSRVALPADAAALLYEGDKLACGTRRLAHTEQFRWLDRAAVVTPTTDKDDDTGSRWRLCPVTQVEELKAVVRLLPVWASGIVMSAVYGQMSTMFVLQGNTLDPRMGATFKIPSASLSIFDTLAVLAWVPVYDRLIVPAARRFTGHPRGFTQLQRMGIGLLISVFSMVAAGVLEVVRLRVAAAHGMLDSTSYLPISIFWQVQYFIIGQIDFFYDQAPDDMRSTCTALSLTSSALGNYLSTLLVVIVTAASTRGGGLGWIPDNLNRGHLDYFFWLLAALSAVNFLVYLWIANWYRCKTITTTEAAAQT

SEQ ID NO: 458 - DNA, 1710 bp, Populus balsamifera subsp. trichocarpa
  misc_feature: Ceres Annot ID no. 1529287
  misc_feature: Encodes the peptide sequence at SEQ ID NO. 459
atggcagaaactgattacacaaacaatgggacggtggatatcgaaggaaatccagctaataagaagaaaactggaaactggaagtcttgccgctttattcttgggaatgaatgctgtgagaggttggcatactacgggatgagtacgaatctagtgaactatcttggggaccgtctcaaccagggaaatgttgctgcagcaaacaatgtcaccaattggtctggaacttgctatgtcacaccactgattggagcctttctagcagattcatatttgggaagatattggacaattgcgagttttgttatcatatatatcattggaatgacactcctaacattgtctgcttcggtcactggtctgaagccatcatgtgataaggattcttgccacccgaccacaggacaaactgcagcatgctttgtagcactttacatgatcgctcttggaactggaggaatcaagccatgtgtttcatcctttggcgcagatcaatttgatgaaactgatgagaccgagaggaaaaagaaaagctccttttttaattggttttacctttcaatcaatatcggcgcgcttgttgcgtcttctgttttggtctggatacaaatgaatgttggctggggatgggggtttggagtcccagcagttgccatggctgtagcggttgtgtttttcttcttaggaagcaagctataccgaattcaaaaacctggtgggagtcccattacaaggattgtccaggttatagttgcatccttcagaaagagtaatgttcaagttcctgctgataaatctcttctttacgagactgcagaggaggaaagtcaaatccaaggaagccgcaagcttgaacataccaacaaattcaagttcttcgataaggctgctgtgaaaacccaagatgacaatataaagggcttaacaagtccatggagactctgcacagtaactcaagttgaagagctcaagtccataatcaggttgctcccagtatgggcatctggaatagtcttctcaactgtgtacagtcaaatgaacaccatgttcgttttgcaaggaaataccatggaccaacacatgggtccacatttccagattccatcagcatcgctctccctctttgatacccttagcgtcatcttctgggctcctgtatacgatcgaatcattgtcccatatgcaaggaaatttacgggtcatgaacgaggctttactcagctccaacgcatgggcattggcctcgtcatatcaattgtgtccatgatcactgctggaatattggaggttgttcggctcaactttgtccaaaagaacaattactatgatcttaagtacatcccaatgtccattttctggcaagtaccgcagtactttctcattggatgtgcagaagtttttaccttcattggacagttggagtttttctacgaccaggcaccagatgctatgagaagtttgtgctcagctctttcgcttaccactgtcgcattaggaaattacttgagcactctgcttgtcaccattgttactaaaatcacaacgagaggtgggaagctcggttggattcctgataatatgaacaggggccatcttgattacttctactggctcttggcaattctcagcttcctgaacttcattttgtatctctggatttcaaaatggtttacctacaagaaagctacagggcatcctcaacgagactga

SEQ ID NO: 459 - protein, 569 aa, Populus balsamifera subsp. trichocarpa
  misc_feature (95)..(496): Pfam Name: PTR2 Pfam Description: POT family
  misc_feature: Ceres Annot ID no. 1529287
  misc_feature: Bit score of 1172.9 for HMM based on sequences of Figure 11
  misc_feature: Functional Homolog Of SEQ ID NO. 426
MAETDYTNNGTVDIEGNPANKKKTGNWKSCRFILGNECCERLAYYGMSTNLVNYLGDRLNQGNVAAANNVTNWSGTCYVTPLIGAFLADSYLGRYWTIASFVIIYIIGMTLLTLSASVTGLKPSCDKDSCHPTTGQTAACFVALYMIALGTGGIKPCVSSFGADQFDETDETERKKKSSFFNWFYLSINIGALVASSVLVWIQMNVGWGWGFGVPAVAMAVAVVFFFLGSKLYRIQKPGGSPITRIVQVIVASFRKSNVQVPADKSLLYETAEEESQIQGSRKLEHTNKFKFFDKAAVKTQDDNIKGLTSPWRLCTVTQVEELKSIIRLLPVWASGIVFSTVYSQMNTMFVLQGNTMDQHMGPHFQIPSASLSLFDTLSVIFWAPVYDRIIVPYARKFTGHERGFTQLQRMGIGLVISIVSMITAGILEVVRLNFVQKNNYYDLKYIPMSIFWQVPQYFLIGCAEVFTFIGQLEFFYDQAPDAMRSLCSALSLTTVALGNYLSTLLVTIVTKITTRGGKLGWIPDNMNRGHLDYFYWLLAILSFLNFILYLWISKWFTYKKATGHPQRD

SEQ ID NO: 460 - DNA, 2248 bp, Panicum virgatum
  misc_feature: Ceres Clone ID no. 1806748
  misc_feature: Encodes the peptide sequence at SEQ ID NO. 461
gtggcgctcctcccggtcccggccgcctcctctcctctcttccctcgtctcgcggtcgcgcccagagccgagaggaggaacaggcagggagattccacgcgcccggcagttacgataccgcgccgcagattccctcgtcgctgctcccccaagccctcccgcaccagcagcgccgccgccctccgccgccggctctccagtccagtccaggataggaggcctctgactctctgagctgcacaccatctgagcgacgccatgggagaggtcgcagacatgtacacccaagacgggaccgtcgacatgaagggcaacccggccgtgaagaagggcaccggcaactggcgcgcctgcccttacatcctcgcgaacgagtgctgcgagaggctggcgtactacagcatgagcaccaacctggtgaactacatgaagacccgcctcggccaggggaactccgtcgccgccaacaacgtcaccaactggagcggaacgtgctacatcacgccactcatcggcgcattcttggctgacgcctacatggggagatactggaccatcgccagcttcatgatcatctacatcattggcctgacgctgctgacaatggcgtcgtcggtgaaggggctggtgccgtcgtgcgacggcagcgggacgtgccacccgacggagtcgcagtcggcggcggtgttcgtggcgctgtacctgatcgcgctgggcacgggcggcatcaagccctgcgtgtcgtccttcggcgccgaccagtttgacgagaacgacgagcgggagaacaagagcaagagctccttcttcaactggttctacttctccatcaacatcggcgcgctggtggcgtcgacggtgctggtgtacgtgcagacgcacgtcggctggggctggggctttggcatccccgccgtggtgatggccatcgccgtcgtgagcttcttcgtcggcacgccgctgtaccggcaccagcgccccgggggcagcccggtcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctcgagcacacggaccagttccgctgcctcgacaaggcggccgtcgtgacggcccctgacggcgcggcggcggcggcgccgagcccgtggcggctgtgcacggtgacccaggtggaggagcttaagagcgtggtccggctgctgcccatctgggcgaccgggatcgtgttcgcgacggtgtacgggcagatgagcaccatgttcgtgctgcagggcaacacgctggaccagcgcatggggccccggttcagcatcccctcggcgacgctctccatggtggacaccatcagcgtcatcatctgggtgcccatctacgaccgcctcatcgtgcccgcggcgcgctccgtcacgggccgcccgcgcgggttcacgcagctgcagcgcatgggcatcggcctcgtcatctccatcttctccatggtcgccgcgggcgtgctcgacgtcgtgcggctgcgcgccgtggcgcggcacgggctgtatggcgacaaggacacggtgcccatctccatcttctggcagatcccgcagtacttcatcatcgggtgcgccgaggtgttcaccttcgtggggcagctcgagttcttctacgaccaggctcccgacgccatgaggagcctgtgctcggcgctgtcgctcaccaccgtggcgctgggcaactacctgagcacggtgctggtgaccatcgtgacgcgcatcaccaccaggcacggcaggctcgggtggatcccggacaacctcaaccgcggccacctcgactacttcttctggctgctcgccgtgctcagcctcctcaacttcctcgtctacctgctcatcgccaggtggtacaaatacaagaagacggcggaatacccggacgccaccaaaggggagcgcaaccaggaacactgatcaagcggtggtgcagggctacatacaggctgactggacggagaagaagaagaaaaccaagtgattaaattctctctgttcggttggcttccgatttgttcgtgggagttcgcgtgtttaaacgtactagttcactgtaggtgacaggggtcgaatggattgcttagtatgtcatgtgtcagtaatatgcgcaatgcttgatctcaaatatcagtagtatctataaaataagttcagctcc

SEQ ID NO: 461 - protein, 582 aa, Panicum virgatum
  misc_feature (97)..(501): Pfam Name: PTR2 Pfam Description: POT family
  misc_feature: Ceres Clone ID no. 1806748
  misc_feature: Bit score of 1204.3 for HMM based on sequences of Figure 11
  misc_feature: Functional Homolog Of SEQ ID NO. 426
MGEVADMYTQDGTVDMKGNPAVKKGTGNWRACPYILANECCERLAYYSMSTNLVNYMKTRLGQGNSVAANNVTNWSGTCYITPLIGAFLADAYMGRYWTIASFMIIYIIGLTLLTMASSVKGLVPSCDGSGTCHPTESQSAAVFVALYLIALGTGGIKPCVSSFGADQFDENDERENKSKSSFFNWFYFSINIGALVASTVLVYVQTHVGWGWGFGIPAVVMAIAVVSFFVGTPLYRHQRPGGSPVTRIAQVLVASARKWSVAVPADKAQLHETLDKESGIEGSRKLEHTDQFRCLDKAAVVTAPDGAAAAAPSPWRLCTVTQVEELKSVVRLLPIWATGIVFATVYGQMSTMFVLQGNTLDQRMGPRFSIPSATLSMVDTISVIIWVPIYDRLIVPAARSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTRHGRLGWIPDNLNRGHLDYFFWLLAVLSLLNFLVYLLIARWYKYKKTAEYPDATKGERNQEH

SEQ ID NO: 462 - DNA, 1794 bp, Glycine max
  misc_feature: Ceres Annot ID no. 8755095
  misc_feature: Encodes the peptide sequence at SEQ ID NO. 463
atggcctgcttagaagtcagcaaagagggaaagttcaaaggtgacacagaagaactcactcttgatggaagtgttgattggcatggtcgcccagcaatcagagccaaatctggcagatgggttgctggaaccatcgttctattgaaccaaggtctggcaaccttagcattctttggagtaggggttaacctagtgctgttcctgacaagagtgatggggcaaaataatgctgcagctgcaaacagtgtgagcaaatggactggcacagtttacatcttctctctagtgggtgctttcctaagtgattcttattggggaagatacaaaacttgtgccatctttcaggtcatctttgtaataggtctagtatcattgtccctttcatcatacctctccttgattaggcctaaaggttgtgggaatgaaacaattccatgtgggaagcattcaagcttggagatggggatgttctacctctcaatttatctcattgctttagggaatggagggtatcagccaaatattgccacatttggagctgaccagtttgacgaggagcactcaaaggagggttactcaaaggttgccttctttagctacttctacctggctttgaaccttggttcactcttctcaaacacaattctaggctattttgaagatgaaggactgtgggctctagggttctgggtgtctgcaggctctgcttttgccgcccttgtcttgtttcttcttgggaccccacgatatagacacttcaaacccagtggcaatcctctttcaaggttcagccaagtccttgttgctgcatcaaggaaatggagagctcaaatgacatcaaatggagaggacctatatgtcatggatgaaaatgaatctcccaccaatggcaacaggaagattctccacacaggcgggttcaaatttctggatagagcagcgtttatatctcccagagatctagaagaccaaaagagtggggtttacaacccctggcgtctctgccctataactcaagttgaagaagtgaagtgcatactaagacttcttccaatttggctctgcaccataatatactcagtggttttcacacaaatggcttctctttttgtggagcaaggggctgccatgaaaactacaatttccaatttcagaataccacctgcaagcatgtctagctttgacatcctcagtgtagctgtcttcattttcttctaccgtcgagtgattgatccacttgttggaagacttaaaaagaaaagttccaggggacttactgagcttcaaagaatgggaattgggcttgttatagctgtaatggctatggtttcagctggaatagttgaatgctacagacttaagtatgcaaactcaggatgcccccactgcagtggcacaagctctctaagcatcttctggcaaattcctcagtacgcacttattggagcttcagaggtttttatgtatgtaggccagttagagttcttcaatgctcagacgccagatggcttaaagagctttggaagtgccctttgcatgacgtccatctctcttgggaactacgtaagtagcatacttgttagtatagttatgaagatctccaccgaggatcacatgccagggtggatccctggaaacttaaatagaggtcacctagataggttttatttcctcttagctatcttgacatcaatagacttggtcctttatattgcatgtgcaaagtggttcaagagtatacagttggaagggaaatatgaagagaatgatatgcctggtagctttaaagtctaa

SEQ ID NO: 463 - protein, 597 aa, Glycine max
  misc_feature (108)..(516): Pfam Name: PTR2 Pfam Description: POT family
  misc_feature: Ceres Annot ID no. 8755095
  misc_feature: Bit score of 1276.1 for HMM based on sequences of Figure 11
  misc_feature: Functional Homolog Of SEQ ID NO. 426
MACLEVSKEGKFKGDTEELTLDGSVDWHGRPAIRAKSGRWVAGTIVLLNQGLATLAFFGVGVNLVLFLTRVMGQNNAAAANSVSKWTGTVYIFSLVGAFLSDSYWGRYKTCAIFQVIFVIGLVSLSLSSYLSLIRPKGCGNETIPCGKHSSLEMGMFYLSIYLIALGNGGYQPNIATFGADQFDEEHSKEGYSKVAFFSYFYLALNLGSLFSNTILGYFEDEGLWALGFWVSAGSAFAALVLFLLGTPRYRHFKPSGNPLSRFSQVLVAASRKWRAQMTSNGEDLYVMDENESPTNGNRKILHTGGFKFLDRAAFISPRDLEDQKSGVYNPWRLCPITQVEEVKCILRLLPIWLCTIIYSVVFTQMASLFVEQGAAMKTTISNFRIPPASMSSFDILSVAVFIFFYRRVIDPLVGRLKKKSSRGLTELQRMGIGLVIAVMAMVSAGIVECYRLKYANSGCPHCSGTSSLSIFWQIPQYALIGASEVFMYVGQLEFFNAQTPDGLKSFGSALCMTSISLGNYVSSILVSIVMKISTEDHMPGWIPGNLNRGHLDRFYFLLAILTSIDLVLYIACAKWFKSIQLEGKYEENDMPGSFKV

SEQ ID NO: 464 - protein, 592 aa, Vitis vinifera
  misc_feature (109)..(517): Pfam Name: PTR2 Pfam Description: POT family
  misc_feature: Public GI ID no. 147827175
  misc_feature: Bit score of 1308.0 for HMM based on sequences of Figure 11
  misc_feature: Functional Homolog Of SEQ ID NO. 426
  misc_feature (577)..(577): Xaa is any aa, unknown, or other
MGINLEVSKEVKFKAGEEACTLDGTVDCRGNPAIRSRSGKWFAGIIILLNQGLATLAFFGVGVNLVLFLTRVLQQNNADAANNVSKWTGTVYIFSLVGAFLSDSYWGRYKTCAIFQVIFVIGLVSLSLSSYIFLVKPEGCGNEDSPCPSHSSLEIGLFYLSIYLVALGNGGYQPNIATLGADQFDEEDPKEGHSKVAFFSYFYLALNLGSLFSNTILSYLEDEGMWALGFWVSAGSAFLALILFLGGTPRYRHFKPSGNPLSRFCQVMVAAMRKFRVEMPPSAEDLYEGDGKECSNNSIRRILHTDGFKFLDRAAFISSKDSDNQEQGFYNQWRLCPITQVEEVKCILRLIPIWLCTIIYSVVFTQMASLFVEQGAAMKTTVSNFRIPPASMSSFDILSVAAFIFLYRRVLDPLVGRIRKTDTKGLTELQRMGIGLIIAIIAMIAAGIVECYRLKYAQKDCTNCEGSSSLSIFWQVPQYAFIGASEVFMYVGQLEFFNAQTPDGLKSFGSALCMTSISLGNYVSSLLVTMVMKISTEDHMPGWIPGNLNKGHLDRFYFLLATLTALDLVVYVACAKXYKCIKMEBRANEYGV

SEQ ID NO: 465 - DNA, 2631 bp, Panicum virgatum
  misc_feature: Ceres Clone ID no. 1888865
  misc_feature: Encodes the peptide sequence at SEQ ID NO. 466
acctcgtccgcctcgttggctccgcaccgctgcatctctctagagacaaaggcaggccgcgtgctcccctgcgtagtccttcgagcaggtacgagcggcctcctcctccgtcttcttgattccgccatggcttctgcagcagtagaggggtggagattccggcggtttctgaatcttcttgtttctgtgctttatgagttatgagtatggttggtaatggcgtccgcttgctagtggccactatgctgaaaaattgggcgagcctttagtgttcagaactcgatgaccaacttctaggagttaggtctgcctcaaattcagatccccccactttgtttgtgtggattactgaagtggccaataatttgagcaatttgtccattttttccctcgactaacttgtgccaacaaaaaatgtttttttcttgaagaaatttgatgtctgtatttgagtcgttaaatcgtgtcccatttatattgtttctattctgatgcaaatccacgcctagtcacaatctctgaaatttcaaggcttcttgtgcacacttgctccgtttattgacatctaggactatcacactgaatcttcagtaacagtatcgttgtatgctcgcaggacaggaggcctctgattctctgagcttgtacaccatctgagcgacgccatgggagaggttgcagacatgtacacccaagacgggaccgtcgacatgaaggggaaccccgccgtgaagaagggcaccggcaactggcgcgcctgcccttacatcctcgcgaatgagtgctgcgagaggctggcgtactatggcatgagcaccaacctggtgaactacatgaagacccgcctcggccaggggaactctgtcgccgccaacaatgtcaccaactggagcggaacgtgctacatcacgccactcatcggcgcattcttggctgacgcctacatggggagatactggaccatcgcgagcttcatgatcatctacatcattggcctggcgctgctgacgatggcgtcgtcggtgaaggggctggtgccgtcgtgcgacagcagcgggacgtgccacccgacggagtcgcagtcggcggcagtgttcgtggcgctgtacctgatcgcgctgggcacgggcgggatcaagccctgcgtgtcatcctttggcgccgaccagttcgacgagaacgacgagcgggagcagaagagcaagagctccttcttcaactggttctacttctccatcaacatcggcgcgctggtggcgtcgacggtgctggtgtacgtgcagacgcacgtcggctggggctggggcttcggcatccccgccgtggtgatggccatcgccgtcgtcagcttcatcatcggcacgccgctgtaccggcaccagcgccccgggggcagcccgatcacgcgcatcgcgcaggtgctcgtcgcgtccgcgcgcaagtggagcgtggccgtgcccgccgacaaggcgcagctgcacgagacgctggacaaggagtccggcatcgagggcagccgcaagctagagcacacggaccagttcagctgcctcgacaaggcggccgtcgtgacggccaaggacggggcggcggtgagcccgtggcggctgtgcacggtgacgcaggtggaggagctcaagagcgtggtgcggctgctgcccatctgggcgaccgggatcgtgttcgcgacggtgtacgggcagatgagcaccatgttcgtgctgcagggcaacacgctggaccagcgcatgggccccaggttcagcatcccctcggcgacgttgtccatggtggacaccatcagcgtcatcatctgggtgcccatctacgaccgcgccatcgtgcccttcgtgcggtccgtgacggggcgcccgcgcgggttcacgcagctgcagcgcatgggcatcggcctcgtgatctccatcttctccatggtggcggcgggcgtgctcgacgtggtgcggctgcgcgccgtggcgcggcacggcctgtacggcgacaaggacacggtgcccatctccatcttctggcagatcccgcagtacttcatcatcgggtgcgcggaggtgttcaccttcgtggggcagctggagttcttctacgaccaggcgcccgacgccatgaggagcctgtgctcggcgctgtcgctcaccaccgtggcgctgggcaactacctgagcacggtgctggtgaccatcgtgacgcgcatcaccaccacgcacggcaggctcgggtggatcccggacaacctcaaccgcggccacctcgactacttcttctggctgctcgccgtgctcagcctcctcaacttcctcgtctacctggtcatcgccaagtggtacaagtacaagaagacggcggaatacccggacgccaaaggcggggagcacaactgatgaagcggtgcagggcagggctgcaggctgactgaacggacaaggcgaaaacgaagtgatttctctgtctgtgtggttggctctttcggtttgtttgtgagagttcgccgcgtgtttaaacgtagcagttcactgtaggtgacagggtcgaatgaattgtttagtatgtcatgtgtcagtaatacgcgcaatgcttgatcccaactatcagtatctataaaataagttcagctcc

SEQ ID NO: 466 - protein, 576 aa, Panicum virgatum
  misc_feature (97)..(498): Pfam Name: PTR2 Pfam Description: POT family
  misc_feature: Ceres Clone ID no. 1888865
  misc_feature: Bit score of 1202.6 for HMM based on sequences of Figure 11
  misc_feature: Functional Homolog Of SEQ ID NO. 426
MGEVADMYTQDGTVDMKGNPAVKKGTGNWRACPYILANECCERLAYYGMSTNLVNYMKTRLGQGNSVAANNVTNWSGTCYITPLIGAFLADAYMGRYWTIASFMIIYIIGLALLTMASSVKGLVPSCDSSGTCHPTESQSAAVFVALYLIALGTGGIKPCVSSFGADQFDENDEREQKSKSSFFNWFYFSINIGALVASTVLVYVQTHVGWGWGFGIPAVVMAIAVVSFIIGTPLYRHQRPGGSPITRIAQVLVASARKWSVAVPADKAQLHETLDKESGIEGSRKLEHTDQFSCLDKAAVVTAKDGAAVSPWRLCTVTQVEELKSVVRLLPIWATGIVFATVYGQMSTMFVLQGNTLDQRMGPRFSIPSATLSMVDTISVIIWVPIYDRAIVPFVRSVTGRPRGFTQLQRMGIGLVISIFSMVAAGVLDVVRLRAVARHGLYGDKDTVPISIFWQIPQYFIIGCAEVFTFVGQLEFFYDQAPDAMRSLCSALSLTTVALGNYLSTVLVTIVTRITTTHGRLGWIPDNLNRGHLDYFFWLLAVLSLLNFLVYLVIAKWYKYKKTAEYPDAKGGEHN

SEQ ID NO: 467 - protein, 569 aa, Vitis vinifera
  misc_feature (96)..(498): Pfam Name: PTR2 Pfam Description: POT family
  misc_feature: Public GI ID no. 157337163
  misc_feature: Bit score of 1128.1 for HMM based on sequences of Figure 11
  misc_feature: Functional Homolog Of SEQ ID NO. 426
MAEEDNYTKDGTINYQGNPANKKKTGTWTACPYILGNEFCERLAYYGMSSNLVLYFKYKLHQDSATASKNVLNWSGTCYLTPFIGAFLADAYLGRYWTIASFSIIYVIGMTLLTVTASVPGLKPNCSPSGVCDPTETQTAVCFLALYLVALGTGGIKPCVSSYGADQFDDTDEHEKTHKSSFFNWFYLSINVGALIAGSILVWIQENIGWGVGFGIPAAAMAIAVVSFFSGTRLYRNQKPGGSPLTRMSQVVVASLKKYRVQVPADKSLLYEIADGESGIQGSRKLDHTKDLSFFDKAAVEIQSDHIKDSPDPWKICTVTQVEELKAIIRLLPVWATGIIFSAVYSQMGSLFVVQGESMDPHMGRHFEIPSASLSIFDTISVIFWVPIYDRIIVPVARKFTGHSNGITQLQRMGIGLFISIFAMLSAGILEVVRLGIVKRHNYYDHDRIPLSIFYQVPQYFIIGCAEVFTFIGQLEFFYEQAPDAMRSFCSALSLATVALGNYLSSLLVTIVTDVSTRGGKLGWIPDNLNRGHLHYFFFLLAILSVLNLVAFLFVAKWYTYKRAVGTLR

SEQ ID NO: 468 - protein, 580 aa, Oryza sativa subsp. japonica
  misc_feature (98)..(500): Pfam Name: PTR2 Pfam Description: POT family
  misc_feature: Public GI ID no. 115434472
  misc_feature: Bit score of 1204.4 for HMM based on sequences of Figure 11
  misc_feature: Functional Homolog Of SEQ ID NO. 426
MGEVAEDIYTQDGTVDVKGNPATKKNTGNWRACPYILANECCERLAYYGMSTNLVNYMKTRLGQESAIAANNVTNWSGTCYITPLLGAFLADAYMGRFWTIASFMIIYILGLALLTMASSVKGLVPACDGGACHPTEAQTGVVFLALYLIALGTGGIKPCVSSFGADQFDENDEGEKRSKSSFFNWFYFSINIGALVASSVLVYVQTHVGWGWGFGIPAVVMAVAVASFFVGTPLYRHQRPGGSPLTRIAQVLVASARKWGVEVPADGSRLHETLDRESGIEGSRKLEHTGQFACLDRAAVETPEDRSAANASAWRLCTVTQVEELKSVVRLLPIWASGIVFATVYGQMSTMFVLQGNTLDASMGPHFSIPAASLSIFDTLSVIVWVPVYDRLIVPAVRAVTGRPRGFTQLQRMGIGLVISVFSMLAAGVLDVVRLRAIARHGLYGDKDVVPISIFWQVPQYFIIGAAEVFTFVGQLEFFYDQAPDAMRSMCSALSLTTVALGNYLSTLLVTIVTHVTTRNGAVGWIPDNLNRGHLDYFFWLLAVLSLINFGVYLVIASWYTYKKTADSPDDKAEHAGAN

SEQ ID NO: 469 - DNA, 1833 bp, Oryza sativa
  misc_feature: Ceres Annot ID no. 6252512
  misc_feature: Encodes the peptide sequence at SEQ ID NO. 470
atgtctggcaacgacggagacatgaagatgagggtgatcgtcgtggaaggcgatgagacgagtaacgccccgaaggatgtatgctgcgagtacaccctcgatggctccgtggatatcaagggctcaccggcggtgaagggcaagtccggcggatggctcgccggcggccttattcttctgaaccagggtctggcaaccctggcgttcttcggggtaaacgtgaacctggtgttgttcctgacgagggtgctgcagcagagcaacggcgacgccgccaacaacgtgagcaaatggaccggcacggtttacatgttctccctcatcggcgccttcctcagcgactcctactggggccgctacaagacctgcgccatattccaggccatctttgtccttggcctcgcgctgctgtccctgtcgtcgcggctgtacctgatcaggccggtcgggtgcggcacggagcacgtgccctgcgagccgcactccggcgcggagctggggatcttctacatcgcgctgtacatgatcgcgttcggcaacggcgggtaccagcccaacgtcgccaccttcggcgccgaccagttcgacggcgaggacccggccgagtcgcactccaaggtctccttcttcagctacttctacctggcgctcaacctcggctcgctcttctccaacaccttcctcagcttcctcgaggacgagggcaactgggcgctcggcttctgggtctccaccgccgccgcggccaccgcgctgctgctgttcctcggcggcacgctccgctaccggtacatccgccccagcggcaacccggttggcaggatcttccaggtcgcgttcgccgcgtgcaggaactggaaggccggcgagtcgccgggcgccgtgacactctacgagagcgacgagaaggcggattccggtgggaggaagctcctgcacacggaaggtttcaggttcttggaccgtgcggcggtggtgggcgctaacccgaagcttggcacgtgcacccaaccgcgtgacccctggaagctgtgcacggtgacgcaggtggaggaggtgaagagcatcctgcggctcctccccatctggctctgcaccatcctctattcggtcgtgttcacgcagatggcgtcgctgttcgtcgtgcagggcgccgcgatgcgccgcaccacccggttcccgggcttctccgtcccgccctccagcatgtcggccttcgacatcctcaccgtcgccaccaccatcttcctgtaccgccgggccgtctgcccgctcgtgtcgcggctcacgggccgccacaccggcccaaccgagctgcagaggatgggcctcggcctggtgctcggcgcgatggccatggccaccgccggcacggtcgagcacttcaggaaggccggcgccaccacggcgatgagcagcgacctgcacatcatgtggcaggtgccgcagtacgcgctgatcggcgtgtcggaggtgatgatgtacgtcggccagctcgagttcttcaacggggagatgcccgacgcgctcaagagcttcgggagcgcgctctgcatgatgtccatgtcgctcggcaactacttcagcgacgtcatcgtgagcgcggtgaccaaggccaccgccgtgcgcggccgccccggctggatccccgccgaccttaacgagggccacctcgacaagttcttcttcctgctcgccgtgctggccgtcgcggacttcgccgtgtacctcgtgtgcgcgagccggtacaggagtggcacggtggacgtcgaccggagcgacggggaggaggaggatggcgtggccggcaggcagatggcggcaacggtgtaa

SEQ ID NO: 470 - protein, 610 aa, Oryza sativa
  misc_feature (120)..(522): Pfam Name: PTR2 Pfam Description: POT family
  misc_feature: Ceres Annot ID no. 6252512
  misc_feature: Bit score of 1214.3 for HMM based on sequences of Figure 11
  misc_feature: Functional Homolog Of SEQ ID NO. 426
MSGNDGDMKMRVIVVEGDETSNAPKDVCCEYTLDGSVDIKGSPAVKGKSGGWLAGGLILLNQGLATLAFFGVNVNLVLFLTRVLQQSNGDAANNVSKWTGTVYMFSLIGAFLSDSYWGRYKTCAIFQAIFVLGLALLSLSSRLYLIRPVGCGTEHVPCEPHSGAELGIFYIALYMIAFGNGGYQPNVATFGADQFDGEDPAESHSKVSFFSYFYLALNLGSLFSNTFLSFLEDEGNWALGFWVSTAAAATALLLFLGGTLRYRYIRPSGNPVGRIFQVAFAACRNWKAGESPGAVTLYESDEKADSGGRKLLHTEGFRFLDRAAVVGANPKLGTCTQPRDPWKLCTVTQVEEVKSILRLLPIWLCTILYSVVFTQMASLFVVQGAAMRRTTRFPGFSVPPSSMSAFDILTVATTIFLYRRAVCPLVSRLTGRHTGPTELQRMGLGLVLGAMAMATAGTVEHFRKAGATTAMSSDLHIMWQVPQYALIGVSEVMMYVGQLEFFNGEMPDALKSFGSALCMMSMSLGNYFSDVIVSAVTKATAVRGRPGWIPADLNEGHLDKFFFLLAVLAVADFAVYLVCASRYRSGTVDVDRSDGEEEDGVAGRQMAATV

SEQ ID NO: 471 - DNA, 1770 bp, Medicago truncatula
  misc_feature: Ceres Annot ID no. 1569074
  misc_feature: Encodes the peptide sequence at SEQ ID NO. 472
atggaaggaaatgagaattacagagaagaggttgttatggaagaaagtggcagagcgaatgagaataaaaaaggaggaaccaaagttgcaaccctcttgttagtgaatcaagcactggctactttagctttctttggagttggagtgaacttggttctgttcctaactagagttcttggtcaagacaatgccgaagctgctaataatgtgagcaagtggacaggaaccgtttacatgttctcattggttggagcatttctcagtgactcttattggggtcgatacttaacctgcacaatctttcaacttttctttgttctcggattggcactgtcatgtttgtcatcatggcgttttttgatcaacccaagtggatgtggtaatggccatattccttgtaagccatcatcaattggagttagcattttctacttttctatatatcttgttgcatttggttatggaggacaccaaccaaccttagcaacctttggagctgaccaatatgatgagaggaatccaaaagagaggagtttaaaagtagctttcttctgttatttttacttttccctcaacgttggatctttgttctccaatactgtattggtctattatgaggacacggggaagtggacaatgggtttctttatatcattgatctctgctatcatagcccttttgacatttttatcaggatctcctaaatatagatacttgaagccatcaggaaaccctgtcgtaagggttgctcaggtttttacagctgctgctaggaaatgggatgttgctccagccaaggcagacaaactttttgaggttctgggttctagatctgccatcaaaggttgtagaaagattctgcacagtgatgattttcgattgatggacaaagctgcaaccattacaaagaatgatgatgagcagattggaaacaatccatggaagctttgcacagtgactcaagttgaggaaacaaaatgcgtgttaagaatgcttccaatttggctatgcaccatttgttactctgttgtatttacacaaatggcatcactatttgttgagcaaggggatgtgatgaactctaacatcggagaatttcatttgccagcagccagcatgtctgtgtttgacatctgtagtgtgctagtatgcactgtaatatatcgcacaatccttgttccgttagtaggaagattgattggtaatacaaggggaattagtgaacttgaaagaatgggaattgggttaataattgcaatgttgtcaatggttgcatcaggtatgacagagatggtaaggctgagaaatataattcctgggcagaaaagaagttcaatgagtatattctatcaaattccacagtatgttctgattggtgcttcagaggttttcatgtatgtgggtcaattggagttctttaatggtcaagcaccagatggaataaaaagttttgggagttcactttgtatggcttcaatttctcttggaaactatgtgagtagcatgcttgttcacgtggtcatgaaaatcactgcaagagggaatgacaaaggttggattccagagaacctaaacaaagggcacatggataggtttttctttcttctagcagggctagttgtttttgattttgtgatttacttgttctgtgctaagtggtacaagagtatcaatgttcaaggtgaccaagaggagttggatgatgatgatgctcaagttattataattaagtcggcatccaaagaccaacctttaacaccacaagaataa

SEQ ID NO: 472 - protein, 589 aa, Medicago truncatula
  misc_feature (95)..(493): Pfam Name: PTR2 Pfam Description: POT family
  misc_feature: Ceres Annot ID no. 1569074
  misc_feature: Bit score of 1140.5 for HMM based on sequences of Figure 11
  misc_feature: Functional Homolog Of SEQ ID NO. 426
MEGNENYREEVVMEESGRANENKKGGTKVATLLLVNQALATLAFFGVGVNLVLFLTRVLGQDNAEAANNVSKWTGTVYMFSLVGAFLSDSYWGRYLTCTIFQLFFVLGLALSCLSSWRFLINPSGCGNGHIPCKPSSIGVSIFYFSIYLVAFGYGGHQPTLATFGADQYDERNPKERSLKVAFFCYFYFSLNVGSLFSNTVLVYYEDTGKWTMGFFISLISAIIALLTFLSGSPKYRYLKPSGNPVVRVAQVFTAAARKWDVAPAKADKLFEVLGSRSAIKGCRKILHSDDFRLMDKAATITKNDDEQIGNNPWKLCTVTQVEETKCVLRMLPIWLCTICYSVVFTQMASLFVEQGDVMNSNIGEFHLPAASMSVFDICSVLVCTVIYRTILVPLVGRLIGNTRGISELERMGIGLIIAMLSMVASGMTEMVRLRNIIPGQKRSSMSIFYQIPQYVLIGASEVFMYVGQLEFFNGQAPDGIKSFGSSLCMASISLGNYVSSMLVHVVMKITARGNDKGWIPENLNKGHMDRFFFLLAGLVVFDFVIYLFCAKWYKSINVQGDQEELDDDDAQVIIIKSASKDQPLTPQE

SEQ ID NO: 473 - DNA, 1647 bp, Populus balsamifera subsp. trichocarpa
  misc_feature: Ceres Annot ID no. 1475845
  misc_feature: Encodes the peptide sequence at SEQ ID NO. 474
atggcagaagatggctctaccaaagatggagcagcagatttccgaaatgaatgctgcgaaaggttggcctactatggaatcaacacaaatctagttaattacctcaaatttcaactaaaccagagcaatgttgtggcggtcaataacgtcaccaattggtcaggaacatgctatgtcatgccattgcttggagcttttcttgctgatgcctacttgggaagatattggacaattgctagtttctctataatctatgtctttggaatgacattgttgacattgtcagcatcgatccatggactaaaaccatcttgcgacagaacgaatgtttgccatacaacagggttgcagacatcagttttctttctaggcctataccttatagccctggggactggagggatcaagccttgtgtctcttcctttggtgcggatcaattcgatgactctgacgaggatgagaagaaaaggaagagttccttcttcaattggttctatttttcaatcaatatcggcgctcttattgctgcttctgtgcttgtttggatacaaaccaatgtaggctggggctggggctttggcatcccagcagtggcaatggcaattgctgttgtgagtttcttttcaggtacacggttatacaggaaccagagacttggagggagtcccttaacacgaatgtgccaagtgctagttgcatccttcaggaaattccgtgtcgaagtgcctaatgacaagtctcttctgtttgagacagcagaccatgaatctgctgtcatgggaagccgcaaacttgaccacacagatcagttaagtttctttgacaaggcagcagtggagactccatcagaccgtctaaaagggtccgcgaatcagtggaaactgtgcaccgtgactcaggttgaagagctcaagtccatcattcggttgcttcctgtatgggcaactggcataatattttctgctgtatacagtcaaatgggaaccttatttgtcctgcagggaaacacaatggaccttcgcatgggcaaatccttcgaaatcccttctgcttcactctccctctttgacacaattagtgtaatcttctgggtaccgatttacgaccgtgccatcgtgccctttgcaagaagatttactggacacaagaatggattcacacagcttcaaagaattgcaattggccttgtaatttccatctttgccatgttggttgctgggactctagagcttgtgaggctccgcgaggtcagaaaacataactactatgaactaaagcacataccaatgtccatattttggcaggtccctcagtatttcattataggatgtgcagaagttttcacatttatcgggcaattagagttcttttatgagcaggcacccgatgccatgaggagcctttgctcagctctctcactcacaaccgctgcacttgggaactacttgagcacattcctagttaatattgtcacggatatgagcaccaggcatggtaagcctggttggataccggacaatttgaatcatggccatcttcattattttttctggctcttggcagtgttgagtgtgctcaacttgggggtctatcttttggttgccagatggtacacttacaagaaagctgtggtgtccagtgattga

SEQ ID NO: 474 - protein, 548 aa, Populus balsamifera subsp. trichocarpa
  misc_feature (75)..(477): Pfam Name: PTR2 Pfam Description: POT family
  misc_feature: Ceres Annot ID no. 1475845
  misc_feature: Bit score of 1063.0 for HMM based on sequences of Figure 11
  misc_feature: Functional Homolog Of SEQ ID NO. 426
MAEDGSTKDGAADFRNECCERLAYYGINTNLVNYLKFQLNQSNVVAVNNVTNWSGTCYVMPLLGAFLADAYLGRYWTIASFSIIYVFGMTLLTLSASIHGLKPSCDRTNVCHTTGLQTSVFFLGLYLIALGTGGIKPCVSSFGADQFDDSDEDEKKRKSSFFNWFYFSINIGALIAASVLVWIQTNVGWGWGFGIPAVAMAIAVVSFFSGTRLYRNQRLGGSPLTRMCQVLVASFRKFRVEVPNDKSLLFETADHESAVMGSRKLDHTDQLSFFDKAAVETPSDRLKGSANQWKLCTVTQVEELKSIIRLLPVWATGIIFSAVYSQMGTLFVLQGNTMDLRMGKSFEIPSASLSLFDTISVIFWVPIYDRAIVPFARRFTGHKNGFTQLQRIAIGLVISIFAMLVAGTLELVRLREVRKHNYYELKHIPMSIFWQVPQYFIIGCAEVFTFIGQLEFFYEQAPDAMRSLCSALSLTTAALGNYLSTFLVNIVTDMSTRHGKPGWIPDNLNHGHLHYFFWLLAVLSVLNLGVYLLVARWYTYKKAVVSSD

SEQ ID NO: 475 - DNA, 1929 bp, Populus balsamifera subsp. trichocarpa
  misc_feature: Ceres Annot ID no. 1501483
  misc_feature: Encodes the peptide sequence at SEQ ID NO. 476
atggaaggcatgaccaaggttgtggcaaacactcttctaaggagacctctcttccctgttccattttccacccatattttcttctttaatggcaacaacaaaagaaaatattctattgctgctatggattcagacccttccaccgattatgtgacaggagaaagtgtcatctctagagaaaatgtagctgtgaacagaatcagaactgaggaagaacacgatattgctagcaataagcgctccattacttggaagagctctggagggtggaaagctgcaagcatcttgctagcaaatcaatgcctggctacactagctttctttggagttggtgtgaatttggttctgttcttaacaagagttcttggtcaaagtaatgctgatgctgccaatagtgtcagcaagtggactggcacagtttatctgtgctcactcataggagctttcctcagtgattcatactggggcagatacttgacctgtgcagtctttcagttaatattcgtttcggggttggcgctcgtatcggtatcatcttgttatttcttgatcaaaccagatggatgtggtgatggagaattagcctgtgagccaacatcgtcggtgggagtggctattttttacttggctatatatttagttgcctttggatatggtgggcatcaaccttctttagccacatttggagcagaccaatttgacgagtcgaaaccgaaagaaaaaaattacaaggcagcttacttttgctatttctattttgcactcaactttggatctctattctcaaacactattttggtgtattttgaggatcatggaaaatggacactaggtttcctggtgtcattaggctctgcagttttagccttggtatcgttcttgtttgggacacctggttaccagtatgtgaaaccttgcggcaaccctttgccgcgagttgctcaggtgtttgtggctgcagttaagaaatgggatgttatcccggcgaaagctgatgaactttatgaagtggaaggaccagaatctgctatcaaagggagcagaaagattcttcatagtgatgattttgagtttttggacaaggcagcaacagtaacagaggatgatctaagtcaccaaaagaatccatggaggctttgcacaataagtcaagtagaggaagctaaatgtgttcttaaaatgttacctatttggctatgcactataatttactctgttgttttcacacaaatggcctccctctttgttgagcaaggagatgtcatgaactcctatgctggaaagtttcacctaccagcagctagcatgtctgcctttgatatctgcagtgtccttgtttgcactgggatttatcgccaaatcctcgtgccattagctggaaggttaagtggtaataccaaggggttaacggagcttcagagaatgggaatcggactcatcattgggatgctagcaatgttcgcagcaggggctactgagattgaaaggctcaagcatgttactgaagggaaaaaagttagctcactaagcatattttggcaaattccacaatacgttcttgtcggtgcatctgaggttttcatgtatgtaggccagttggagttctttaacgggcaagcaccagacgggattaagagttttggaagctcactttgcatggcttcaatctcccttggcaactatgtcagcagcatgctagtcagcatggtgatgaagattacagctaaaggtgacaagcctggatggatcccagatgacttgaacacaggccacatggacaggttctacttcctgattgcagtcttaacagcctttgattttgtgatttacttgttctgtgccaactggtacacgcctatcaacattgatgacagccacggaggaattgggatggaaaagcaagaagatgatgcgcttgcaagagtttaa

SEQ ID NO: 476 - protein, 601 aa, Populus balsamifera subsp. trichocarpa
  misc_feature (117)..(515): Pfam Name: PTR2 Pfam Description: POT family
  misc_feature: Ceres Annot ID no. 1501483
  misc_feature: Bit score of 1181.1 for HMM based on sequences of Figure 11
  misc_feature: Functional Homolog Of SEQ ID NO. 426
MDSDPSTDYVTGESVISRENVAVNRIRTEEEHDIASNKRSITWKSSGGWKAASILLANQCLATLAFFGVGVNLVLFLTRVLGQSNADAANSVSKWTGTVYLCSLIGAFLSDSYWGRYLTCAVFQLIFVSGLALVSVSSCYFLIKPDGCGDGELACEPTSSVGVAIFYLAIYLVAFGYGGHQPSLATFGADQFDESKPKEKNYKAAYFCYFYFALNFGSLFSNTILVYFEDHGKWTLGFLVSLGSAVLALVSFLFGTPGYQYVKPCGNPLPRVAQVFVAAVKKWDVIPAKADELYEVEGPESAIKGSRKILHSDDFEFLDKAATVTEDDLSHQKNPWRLCTISQVEEAKCVLKMLPIWLCTIIYSVVFTQMASLFVEQGDVMNSYAGKFHLPAASMSAFDICSVLVCTGIYRQILVPLAGRLSGNTKGLTELQRMGIGLIIGMLAMFAAGATEIERLKHVTEGKKVSSLSIFWQIPQYVLVGASEVFMYVGQLEFFNGQAPDGIKSFGSSLCMASISLGNYVSSMLVSMVMKITAKGDKPGWIPDDLNTGHMDRFYFLIAVLTAFDFVIYLFCANWYTPINIDDSHGGIGMEKQEDDALARV

SEQ ID NO: 477 - DNA, 1821 bp, Populus balsamifera subsp. trichocarpa
  misc_feature: Ceres Annot ID no. 8755079
  misc_feature: Encodes the peptide sequence at SEQ ID NO. 478
atggattcgttctcttccaccaacgctgtgctaaagaagcaggtgacaggagaaagtagtatcatctctagggaaaatgtagctgtgaagagaatcagaactgaggaagaacaggagattgctaacagaaagccttcccttatttggaagagaactggagggtggacagctgcaagcatcttgctagcaaatcaatgcctggctacactagctttctttggagttggtgtgaatttggttctattcttaacaagagttcttggtcaaagtaatgctgatgctgccaataatgtcagcaagtggactggcacagtttatctgtgctcactcgtaggagctttcctcagtgattcatactggggtagatacttgacctgtgcaatctttcagctaatattcgtctcgggattggtgctcgtatcggtatcatcttggtttttcttgatcaaaccagatggatgtggtgatggaaaattaacctgtgtgccggcaacatcgatgggacaagttgttttctacttggctatatacttagtagcctttggatatggtggacatcaaccttccatagcgacatttggagcagatcaatttgacgagtcgaaaccgaaagaaagaaattccaaggcagctttcttttgctatttctattttgcactcaactttggatctttattctcaaacacccttttggtgtactttgaggatcatggcagatggacactaggcttcctgctatcattaggttctgcagtcgtagccttggtatcattcttgtttggggcacctggttacaagtacgtaaaaccttgcggcaaccctttgccgcgagttgctcaggtgtttgtggctgcagctaggaaatgggatgttatcccggtgaaagctgatgaactgtatgaactagaaggaccagaatctgctatcaaagggagcaggaagatttttcacagtgaagaatttgagtttttggacaaggcagcaacaatgacagaggatgatttgagtcaccaaaagaatccatggaggctttgcacaataactcaagtagaggaagccaaatgtgttcttaaaatgttacctatttggttatgcactattatttactctgttgtcttcactcagatggcatccctctttgttgagcaaggagatgtcatgaattcctatattggaaagtttcacctcccagctgctagcatgtctgccttcgatatctgcagtgtccttgtttgcactggaatttatcgtcaaatcctcgtgccattagctggaaggttaagtggtaatcctaaggggttaactgagcttcagaggatgggaattggactcgtcattggaatgctagcaatgcttgcagcgggtgctactgagattgaaaggctcaagaatgttattgaagggcacaaagtcagctctttaagcatattttggcaaattccacaatatgttcttgttggtgcatctgaggttttcatgtatataggtcaattggagttctttaacgggcaagcaccagacgggattaagagttttggaagctcactttgcatggcttcaatctctcttggcaactatgccagtagcatgctagttaatatggtgatgaagattacaactaaaggtgacaagcctggatggatcccagatgacttgaacacaggacacatggacaggttttacttcctgattgcagtgttaacagcctttgatttcgtgatttacttgttctgtgccaagtggtacaagcctatcaacattgatgacagtcagggaattgagatggaaaagcaagaagatgatgtgcttgcaaaagtttaa

SEQ ID NO: 478 - protein, 606 aa, Populus balsamifera subsp. trichocarpa
  misc_feature (123)..(521): Pfam Name: PTR2 Pfam Description: POT family
  misc_feature: Ceres Annot ID no. 8755079
  misc_feature: Bit score of 1186.9 for HMM based on sequences of Figure 11
  misc_feature: Functional Homolog Of SEQ ID NO. 426
MDSFSSTNAVLKKQVTGESSIISRENVAVKRIRTEEEQEIANRKPSLIWKRTGGWTAASILLANQCLATLAFFGVGVNLVLFLTRVLGQSNADAANNVSKWTGTVYLCSLVGAFLSDSYWGRYLTCAIFQLIFVSGLVLVSVSSWFFLIKPDGCGDGKLTCVPATSMGQVVFYLAIYLVAFGYGGHQPSIATFGADQFDESKPKERNSKAAFFCYFYFALNFGSLFSNTLLVYFEDHGRWTLGFLLSLGSAVVALVSFLFGAPGYKYVKPCGNPLPRVAQVFVAAARKWDVIPVKADELYELEGPESAIKGSRKIFHSEEFEFLDKAATMTEDDLSHQKNPWRLCTITQVEEAKCVLKMLPIWLCTIIYSVVFTQMASLFVEQGDVMNSYIGKFHLPAASMSAFDICSVLVCTGIYRQILVPLAGRLSGNPKGLTELQRMGIGLVIGMLAMLAAGATEIERLKNVIEGHKVSSLSIFWQIPQYVLVGASEVFMYIGQLEFFNGQAPDGIKSFGSSLCMASISLGNYASSMLVNMVMKITTKGDKPGWIPDDLNTGHMDRFYFLIAVLTAFDFVIYLFCAKWYKPINIDDSQGIEMEKQEDDVLAKV

SEQ ID NO: 479 - protein, 572 aa, Oryza sativa subsp. japonica
  misc_feature (93)..(497): Pfam Name: PTR2 Pfam Description: POT family
  misc_feature: Public GI ID no. 115470147
  misc_feature: Bit score of 1062.2 for HMM based on sequences of Figure 11
  misc_feature: Functional Homolog Of SEQ ID NO. 426
MEATTTDGTTDHAGKPAVRSKSGTWRACPFILGNECCERLAYYGMSANLVNYMVDRLRQGNAGAAASVNNWSGTCYVMPLVGAFLADAYLGRYRTIAAFMALYIVGLALLTMSASVPGMKPPNCATISASSCGPSPGQSAAFFVALYLIALGTGGIKPCVSSFGADQFDDADPREHRSKASFFNWFYMSINVGALVASSVLVWVQMNVGWGWGFGIPAVAMAVAVASFLMGSSLYRHQKPGGSPLTRMLQVVVAAARKSRVALPADAAALLYEGDKLACGTRRLAHTEQFRWLDRAAVVTPTTDKDDDTGSRWRLCPVTQVEELKAVVRLLPVWASGIVMSAVYGQMSTMFVLQGNTLDPRMGATFKIPSASLSIFDTLAVLAWVPVYDRLIVPAARRFTGHPRGFTQLQRMGIGLLISVFSMVAAGVLEVVRLRVAAAHGMLDSTSYLPISIFWQVQYFIIGAAEVFAFIGQIDFFYDQAPDDMRSTCTALSLTSSALGNYLSTLLVVIVTAASTRGGGLGWIPDNLNRGHLDYFFWLLAALSAVNFLVYLWIANWYRCKTITTTEAAAQT

SEQ ID NO: 480 - protein, 570 aa, Arabidopsis thaliana
  misc_feature (97)..(499): Pfam Name: PTR2 Pfam Description: POT family
  misc_feature: Public GI ID no. 15240905
  misc_feature: Bit score of 1099.4 for HMM based on sequences of Figure 11
  misc_feature: Functional Homolog Of SEQ ID NO. 426
MEDDKDIYTKDGTLDIHKKPANKNKTGTWKACRFILGTECCERLAYYGMSTNLINYLEKQMNMENVSASKSVSNWSGTCYATPLIGAFIADAYLGRYWTIASFVVIYIAGMTLLTISASVPGLTPTCSGETCHATAGQTAITFIALYLIALGTGGIKPCVSSFGADQFDDTDEKEKESKSSFFNWFYFVINVGAMIASSVLVWIQMNVGWGWGLGVPTVAMAIAVVFFFAGSNFYRLQKPGGSPLTRMLQVIVASCRKSKVKIPEDESLLYENQDAESSIIGSRKLEHTKILTFFDKAAVETESDNKGAAKSSSWKLCTVTQVEELKALIRLLPIWATGIVFASVYSQMGTVFVLQGNTLDQHMGPNFKIPSASLSLFDTLSVLFWAPVYDKLIVPFARKYTGHERGFTQLQRIGIGLVISIFSMVSAGILEVARLNYVQTHNLYNEETIPMTIFWQVPQYFLVGCAEVFTFIGQLEFFYDQAPDAMRSLCSALSLTAIAFGNYLSTFLVTLVTKVTRSGGRPGWIAKNLNNGHLDYFFWLLAGLSFLNFLVYLWIAKWYTYKKTTGHAL

SEQ ID NO: 481 - DNA, 1809 bp, Populus balsamifera subsp. trichocarpa
  misc_feature: Ceres Annot ID no. 8755085
  misc_feature: Encodes the peptide sequence at SEQ ID NO. 482
atggattcagacccttccaccgattatcaggtgacaggagaaagtgtcatctctagagaaaatgtagctgtgaacagaatcagaactgaggaagaacacgatattgctagcaataagcgctccattacttggaagagctctggagggtggaaagctgcaagcatcttgctagcaaatcaatgcctggctacactagctttctttggagttggtgtgaatttggttctgttcttaacaagagttcttggtcaaagtaatgctgatgctgccaatagtgtcagcaagtggactggcacagtttatctgtgctcactcataggagctttcctcagtgattcatactggggcagatacttgacctgtgcagtctttcagttaatattcgtttcggggttggcgctcgtatcggtatcatcttgttatttcttgatcaaaccagatggatgtggtgatggagaattagcctgtgagccaacatcgtcggtgggagtggctattttttacttggctatatatttagttgcctttggatatggtgggcatcaaccttctttagccacatttggagcagaccaatttgacgagtcgaaaccgaaagaaaaaaattacaaggcagcttacttttgctatttctattttgcactcaactttggatctctattctcaaacactattttggtgtattttgaggatcatggaaaatggacactaggtttcctggtgtcattaggctctgcagttttagccttggtatcgttcttgtttgggacacctggttaccagtatgtgaaaccttgcggcaaccctttgccgcgagttgctcaggtgtttgtggctgcagttaagaaatgggatgttatcccggcgaaagctgatgaactttatgaagtggaaggaccagaatctgctatcaaagggagcagaaagattcttcatagtgatgattttgagtttttggacaaggcagcaacagtaacagaggatgatctaagtcaccaaaagaatccatggaggctttgcacaataagtcaagtagaggaagctaaatgtgttcttaaaatgttacctatttggctatgcactataatttactctgttgttttcacacaaatggcctccctctttgttgagcaaggagatgtcatgaactcctatgctggaaagtttcacctaccagcagctagcatgtctgcctttgatatctgcagtgtccttgtttgcactgggatttatcgccaaatcctcgtgccattagctggaaggttaagtggtaataccaaggggttaacggagcttcagagaatgggaatcggactcatcattgggatgctagcaatgttcgcagcaggggctactgagattgaaaggctcaagcatgttactgaagggaaaaaagttagctcactaagcatattttggcaaattccacaatacgttcttgtcggtgcatctgaggttttcatgtatgtaggccagttggagttctttaacgggcaagcaccagacgggattaagagttttggaagctcactttgcatggcttcaatctcccttggcaactatgtcagcagcatgctagtcagcatggtgatgaagattacagctaaaggtgacaagcctggatggatcccagatgacttgaacacaggccacatggacaggttctacttcctgattgcagtcttaacagcctttgattttgtgatttacttgttctgtgccaactggtacacgcctatcaacattgatgacagccacggaggaattgggatggaaaagcaagaagatgatgcgcttgcaagagtttaa

SEQ ID NO: 482 - protein, 602 aa, Populus balsamifera subsp. trichocarpa
  misc_feature (118)..(516): Pfam Name: PTR2 Pfam Description: POT family
  misc_feature: Ceres Annot ID no. 8755085
  misc_feature: Bit score of 1181.0 for HMM based on sequences of Figure 11
  misc_feature: Functional Homolog Of SEQ ID NO. 426
MDSDPSTDYQVTGESVISRENVAVNRIRTEEEHDIASNKRSITWKSSGGWKAASILLANQCLATLAFFGVGVNLVLFLTRVLGQSNADAANSVSKWTGTVYLCSLIGAFLSDSYWGRYLTCAVFQLIFVSGLALVSVSSCYFLIKPDGCGDGELACEPTSSVGVAIFYLAIYLVAFGYGGHQPSLATFGADQFDESKPKEKNYKAAYFCYFYFALNFGSLFSNTILVYFEDHGKWTLGFLVSLGSAVLALVSFLFGTPGYQYVKPCGNPLPRVAQVFVAAVKKWDVIPAKADELYEVEGPESAIKGSRKILHSDDFEFLDKAATVTEDDLSHQKNPWRLCTISQVEEAKCVLKMLPIWLCTIIYSVVFTQMASLFVEQGDVMNSYAGKFHLPAASMSAFDICSVLVCTGIYRQILVPLAGRLSGNTKGLTELQRMGIGLIIGMLAMFAAGATEIERLKHVTEGKKVSSLSIFWQIPQYVLVGASEVFMYVGQLEFFNGQAPDGIKSFGSSLCMASISLGNYVSSMLVSMVMKITAKGDKPGWIPDDLNTGHMDRFYFLIAVLTAFDFVIYLFCANWYTPINIDDSHGGIGMEKQEDDALARV

SEQ ID NO: 483 - protein, 551 aa, Vitis vinifera
  misc_feature (115)..(519): Pfam Name: PTR2 Pfam Description: POT family
  misc_feature: Public GI ID no. 147853446
  misc_feature: Bit score of 1137.1 for HMM based on sequences of Figure 11
  misc_feature: Functional Homolog Of SEQ ID NO. 426
MGSQEEEEVRSLLETGLLQNENSDLHTGDGSVDIHGKPVLRSNTGNWRACPFILGTECCERLAYYGIATNLVTYLTSKLHEGNVSAARNVTTWQGTCYLTPLIGAVLADAYCGRYWTIAAFSTIYFIGMCTLTLSATVPAFKPADCVGSVCPPATTAQYAVFFFGLYLIALGTGGIKPCVSSFGADQFDDTDPKERVKKGSFFNWFYFSINIGALVSSSFLVWIQDNAGWGLGFGIPALFMGIAIASFFSGTPLYRFQKPGGSPITRMCQVLVASFRKWKLEVPKDSNLLYETPDKNSAIEGSRKLEHSNELKCLDKAAVISDAEIKSGDFSNPWNLCTVTQVEELKILIRMFPIWATGIVFSAVYAQMSTMFVEQGMVMDTTVGSFTIPPASLSTFDVISVIFWVPVYDRILVPIARKFTGKERGFSELQRMGIGLFLSVLCMSAAALVEIKRLQLATALDLVDEDVAVPLSILWQIPQYFLLGAAEVFTFIGQLEFFYDQSPDAMRSLCSASSLLTTSLGNYLSAFILTVVTTLTTEBGKTGWIPDNLE

SEQ ID NO: 484 - protein, 547 aa, Vitis vinifera
  misc_feature (96)..(497): Pfam Name: PTR2 Pfam Description: POT family
  misc_feature: Public GI ID no. 157346087
  misc_feature: Bit score of 1069.5 for HMM based on sequences of Figure 11
  misc_feature: Functional Homolog Of SEQ ID NO. 426
MAEDDMYTKDGTMNIHNKPANKKKTGQWKACRFILGNECCERLAYYGMSTNLVNYLQIRLNQGNVTASNNVTNWSGTCYITPLIGAFLADAYFGRFWIIAIFSIIYFCGMVLLTMTASIKGLRPSCDDNGCDPTKLQSAVCFIALYLIALGTGGIKPCVSSFGADQFDVNDEAEKKKKSSFFNWFYLSINVGALIASSVLVWIQMNVGWGWGFGIPAVAMAIAVVSFFSGSRMYRLQKPGGSPLTRICQVLVASTRKYHVKVPNNKSLLYETKDAESNIKGSCKLEHTEKLRFFDKAAVEVESDHVKSSNNPWKLCTVTQVEELKSILRLLPVWATGILFSTVYSQMSTMFVLQGNTMDQHMGPNFKIPSASLSLFDTLSVIFWAPVYDRIIVPFARKFTGHERGFTQLQRMGIGLVISIISMIVAGILEVIRLNYVRKHNYYDLEYIPMSIFWQVPQYFLIGCAEVFTFIGQLEFYYDQAPDATRITIVNKVTTRNGKMGWIPDNMNRGHLDYFYWLLAILSLLNFLVYLWIAKWYTYKKVTGRPG

SEQ ID NO: 485 - DNA, 1797 bp, Populus balsamifera subsp. trichocarpa
  misc_feature: Ceres Annot ID no. 1538867
  misc_feature: Encodes the peptide sequence at SEQ ID NO. 486
atggcttgtttggaggtttgtaaggagggtaagttcaaagagggacgagaagaatgcacttttgatggaacagttgattggcatggtcgtcctgctatcaaagacaaatctgggcaatgggttgctggaattattatacttttgaaccaaggtctagcaacacttgcattctttggtgttggtgtgaacttagttctgttcctgacaagggttttgcaacaaagcaatgccgatgctgctaataacgttagcaaatggaccgggaccgtctacatcttctctcttgttggtgctttcctcagcgattcctactggggaagatacaaaacctgtgcaatttttcaggtcatctttgtcataggcctagtaatcctatcactctcgtcataccttttcttaatcagaccaaaaggatgtgggaatgagctgactccatgtggatcccattcaagcatggaagtttcattgttttacctctccatttacctcgttgctctaggaaatggagggtatcaacctaacattgctacatttggggctgatcagtttgatgaagaggaccccagggaaggacattccaaggttgcattttttagctacttctacctggccttgaacctcggttccctcttttccaacacaatattggggtattttgaggatgaaggggtgtgggcactaggattctgggcgtctgcaggttctgcctttgcagcattggtcttgtttctaggaggaacatctagataccggcacttcaaaccaagtggtaaccctctctccaggttctgccaagtcatcatcgctgcaatgaagaaatggaagctcgagatgccacgagatggagaggaggagctgtataatgtccatgcaaaagattgctcgatgaatggcaacagaaagattctccacactgatggattcaagttcttggatagagcagctttcatctcttcaagagatattgatgatcaaaagcggggctgtcgcaacccatggcgtctgtgcccaattacacaagtagaagaagttaaatgcatactgagactactcccaatttggctctgcaccataatctattcagtggttttcacacagatggcctctctgtttgttgagcagggtgctgcaatgaaaactacagtatcaaacttcaaaatccctcctgccagcatgtctagcttcgatattctaagtgttgcgtttttcattttcctatatcggcgagttcttgatccacttgtaagcagagttaaaaagacgggttcaaaaggactaactgaacttcaaagaatgggtgttggccttgtgatagcaatagtggcaatgatttcggctgggcttgtggagtgttatagactcaggtatgcaagaaaagactgcacacactgtgaaggctcaagctctatgagcatcttctggcaagttcctcagtatgcacttattggagcttctgaagttttcatgtatgttggtcaactggagttctttaatgcacaaactcctgatggattaaagagcttcggaagtgcactttgtatgacatctatctcgctagggaattacgtgagtagcttgcttgtgactatggttatgaagatctcgactgaggatcacatgcccggatggatccccggaaatctgaacaaaggtcacctggataggttttacttcctcttagcaaccttgacaactatagacctagttgtgtatatagcatgtgctaggtggtacaagtctatccaactggaaggaaaatgcgagctgaatgatcaggaagagaacttcagagtctga

SEQ ID NO: 486 - protein, 598 aa, Populus balsamifera subsp. trichocarpa
  misc_feature (108)..(517): Pfam Name: PTR2 Pfam Description: POT family
  misc_feature: Ceres Annot ID no. 1538867
  misc_feature: Bit score of 1302.6 for HMM based on sequences of Figure 11
  misc_feature: Functional Homolog Of SEQ ID NO. 426
MACLEVCKEGKFKEGREECTFDGTVDWHGRPAIKDKSGQWVAGIIILLNQGLATLAFFGVGVNLVLFLTRVLQQSNADAANNVSKWTGTVYIFSLVGAFLSDSYWGRYKTCAIFQVIFVIGLVILSLSSYLFLIRPKGCGNELTPCGSHSSMEVSLFYLSIYLVALGNGGYQPNIATFGADQFDEEDPREGHSKVAFFSYFYLALNLGSLFSNTILGYFEDEGVWALGFWASAGSAFAALVLFLGGTSRYRHFKPSGNPLSRFCQVIIAAMKKWKLEMPRDGEEELYNVHAKDCSMNGNRKILHTDGFKFLDRAAFISSRDIDDQKRGCRNPWRLCPITQVEEVKCILRLLPIWLCTIIYSVVFTQMASLFVEQGAAMKTTVSNFKIPPASMSSFDILSVAFFIFLYRRVLDPLVSRVKKTGSKGLTELQRMGVGLVIAIVAMISAGLVECYRLRYARKDCTHCEGSSSMSIFWQVPQYALIGASEVFMYVGQLEFFNAQTPDGLKSFGSALCMTSISLGNYVSSLLVTMVMKISTEDHMPGWIPGNLNKGHLDRFYFLLATLTTIDLVVYIACARWYKSIQLEGKCELNDQEENFRV

SEQ ID NO: 487 - DNA, 1779 bp, Medicago truncatula
  misc_feature: Ceres Annot ID no. 8755091
  misc_feature: Encodes the peptide sequence at SEQ ID NO. 488
atggcttgcttagaggtctgcaaagaggggaagttcaaagaagaaacagaagagttaactcttgatgggagtgttgattggcatggtcgcccatcaatcagagccacatccgggagatggtttgccggaactattatactcttgaaccaaggtctagcaaccttagcattctttggagttggagtgaacctagttctgttcttgacaagggtgttgggtcaagataatgctgctgctgctaacaatgtcagcaagtggactggcacagtttacatcttctctcttgttggtgctttccttagtgattcttattggggaagatacaaaacatgtgctatctttcaaggcatttttgtaaccggtctagtatctttgtccgttacaacataccttgctttgcttagaccaaaaggttgtggaaatggaaaacttgaatgtggggaacattcaagtttggaaatgggaatgttctacctatcaatctatctgattgccttaggaaatggagggtatcaaccaaacattgcaacatttggtgctgaccaatttgatgaagatcactcaaaggagagttattcaaaagtggcattttttagctacttttacttggcattgaaccttggttcacttttctcaaacactattttgggctattttgaagatgaaggattatgggctcttgggttttgggcttctgctgggtctgcctttttggctcttgtactttttcttgttggcaccccaaaatatagacactttaaaccttgtggcaatcctctttctagattctgccaagtgtttttcgctgcttcaaggaaattgggagttcaaatgacttcaaatggagatgacttgtatgtcatagatgaaaaggagtcttctaacaactccaacagaaagattctccacacacatggcttcaagtttttggatagggcagcttatataacttcaagagatttagaggtccaaaaaggaggccaacataacccatggtatctgtgtcctattactcaagttgaagaagtaaaatgcatactaagacttcttccaatttggctttgcacaataatctactcagtagttttcactcagatggcttccctttttgtggagcaaggtgctgcaatgaaaaccacaatttccagtttcaaaataccaccagcaagcatgtctagcttcgatatcctcagcgtagccatcttcattttcttctaccgtcgagtacttgatccactcgtcggaaaactcaaaaaatcaagttccaagggactcactgaacttcaaagaatgggaatcggtctcgttatagctataatcgcaatggttacagctggaatagttgaatgttacaggcttaagtatgcaaaacaaggtgacacaagctctctaagtatcttctggcaaattcctcagtatgcacttataggagcttctgaggtttttatgtatgtaggacaattagaatttttcaatgctcaaacacctgatggattaaagagctttggaagtgcactttgcatgacaagtatctcacttgggaactatgtgagtagcttaattgttagtattgttatgaagatttcaactgaagatcacatgccaggatggatccctggaaacttgaatagaggtcacttggataggtttttcttcctattggctgttttgacttctttagatttgattgcttatattgcatgtgcaaagtggtttcagaatattcagatggcatgcaaatatgataacaatgacgagcctagtagctgcaaagtttaa

SEQ ID NO: 488 - protein, 592 aa, Medicago truncatula
  misc_feature (108)..(511): Pfam Name: PTR2 Pfam Description: POT family
  misc_feature: Ceres Annot ID no. 8755091
  misc_feature: Bit score of 1252.7 for HMM based on sequences of Figure 11
  misc_feature: Functional Homolog Of SEQ ID NO. 426
MACLEVCKEGKFKEETEELTLDGSVDWHGRPSIRATSGRWFAGTIILLNQGLATLAFFGVGVNLVLFLTRVLGQDNAAAANNVSKWTGTVYIFSLVGAFLSDSYWGRYKTCAIFQGIFVTGLVSLSVTTYLALLRPKGCGNGKLECGEHSSLEMGMFYLSIYLIALGNGGYQPNIATFGADQFDEDHSKESYSKVAFFSYFYLALNLGSLFSNTILGYFEDEGLWALGFWASAGSAFLALVLFLVGTPKYRHFKPCGNPLSRFCQVFFAASRKLGVQMTSNGDDLYVIDEKESSNNSNRKILHTHGFKFLDRAAYITSRDLEVQKGGQHNPWYLCPITQVEEVKCILRLLPIWLCTIIYSVVFTQMASLFVEQGAAMKTTISSFKIPPASMSSFDILSVAIFIFFYRRVLDPLVGKLKKSSSKGLTELQRMGIGLVIAIIAMVTAGIVECYRLKYAKQGDTSSLSIFWQIPQYALIGASEVFMYVGQLEFFNAQTPDGLKSFGSALCMTSISLGNYVSSLIVSIVMKISTEDHMPGWIPGNLNRGHLDRFFFLLAVLTSLDLIAYIACAKWFQNIQMACKYDNNDEPSSCKV

SEQ ID NO: 489 - DNA, 1713 bp, Populus balsamifera subsp. trichocarpa
  misc_feature: Ceres Annot ID no. 1492702
  misc_feature: Encodes the peptide sequence at SEQ ID NO. 490
atggcagaggaggatgtttatacaaaagatggaacagtggattatcgtgggaatccagctaacaaaaaggagacgggaacctggagagcctgcccttatattataggaaatgaattttgtgaacgattggcttactatgggatgagctccaatctgattctttatttcaagcacagactgaatcaacaaagcgctacagctactagaaataacttgaattggggtggaacgtgctatctcactccattgattggagcattctttgctgatgcttatcttggtagatattggacgattgcttgtttctccatcatatatgttatggggatgacacttttgacaatctcagctactgtccctggcctaaggccaaaatgttatgcagaagatgattgtaatccaacagatgctcaaagtgcattagcttttgtatcactttacctaatagcactaggcactggtggtattaagccttgtgtctcatcctatggagcagatcagtttgatgacgctgatgaggttgagaaaaaacacaagagttctttcttcaactggttctacctctcaattaatgttggtgctcttattgccggttctgtgctggtttgggtacaagataatgtgagttggggttggggttttggcattccagcaatagccatggcaattgcggttgcgagcttcttttcaggtactcggttgttcaggtatcaaaagcctggaggcagccctcttactcgcatctgtcaggtgctgttggcatccttcagaaaaaagaaagttgaagttccagctgacaaggctttgttgtatgagactgcggatgccgaatccaacatcaaaggaagccgcaagcttgaccatactgaagaatttagtttccttgacaaggcagcagtggaaacagaaaaggacgacataaaggggccagtagacccatggagactttgcactgtaacccaagttgaggagctaaagtctatcattcggttgcttcccatatgggccacaggtatcatctttactgcagtgtacagccagatggggaacctatttgtgctgcaaggtgaacagatggataaatatgttggaaactccaatttccagataccatctgcatctctatcaatctttgacactcttagtgtcattttttgggtcccggtctatgaccgaattattgtcccagttgcaagaaaatacaccggacacaaaaatggcttaactcaactgcagcggatgggcattggtctcttcatatcaatattttccatggtatctgcagcaatcttggaacttaaaagacttgaaatggtgagaaggcacaactcctacgaacttaaaaccgtgcccttgtctatattttggcaagctccacagtatttcctgatagggtgtgcagaagttttcacattcatcggacagttggaattcttctacgagcaagcacctgatgcaatgaggagcatgtgttctgccctatcactcaccaccgtcgcacttggtagttacttaagctctcttcttgtaaccattgttacaagcatcagcactaagaatggaaagcctggatggataccggagaacttaaattatggtcacattgattacttcttctggctactgggagtactcagtgtgctgaatctatgtgtctttctcttgatctcaaattggtacacgtataaaaagccagtgggaactcttcgttga

SEQ ID NO: 490 - protein, 570 aa, Populus balsamifera subsp. trichocarpa
  misc_feature (96)..(499): Pfam Name: PTR2 Pfam Description: POT family
  misc_feature: Ceres Annot ID no. 1492702
  misc_feature: Bit score of 1122.2 for HMM based on sequences of Figure 11
  misc_feature: Functional Homolog Of SEQ ID NO. 426
MAEEDVYTKDGTVDYRGNPANKKETGTWRACPYIIGNEFCERLAYYGMSSNLILYFKHRLNQQSATATRNNLNWGGTCYLTPLIGAFFADAYLGRYWTIACFSIIYVMGMTLLTISATVPGLRPKCYAEDDCNPTDAQSALAFVSLYLIALGTGGIKPCVSSYGADQFDDADEVEKKHKSSFFNWFYLSINVGALIAGSVLVWVQDNVSWGWGFGIPAIAMAIAVASFFSGTRLFRYQKPGGSPLTRICQVLLASFRKKKVEVPADKALLYETADAESNIKGSRKLDHTEEFSFLDKAAVETEKDDIKGPVDPWRLCTVTQVEELKSIIRLLPIWATGIIFTAVYSQMGNLFVLQGEQMDKYVGNSNFQIPSASLSIFDTLSVIFWVPVYDRIIVPVARKYTGHKNGLTQLQRMGIGLFISIFSMVSAAILELKRLEMVRRHNSYELKTVPLSIFWQAPQYFLIGCAEVFTFIGQLEFFYEQAPDAMRSMCSALSLTTVALGSYLSSLLVTIVTSISTKNGKPGWIPENLNYGHIDYFFWLLGVLSVLNLCVFLLISNWYTYKKPVGTLR

SEQ ID NO: 491 - DNA, 1887 bp, Zea mays
  misc_feature: Ceres Clone ID no. 325604
  misc_feature: Encodes the peptide sequence at SEQ ID NO. 492
ggggttgggggaggccctctgtctccatggatgaggcagcagggctgctgttgcaagaagagggtggaggtggggaccaagaagctctcctccttccacttccacaggatgttggcctttacacaggtgatggatctgttgatgtcaaagggcgccctgcgttaaagggcactacaggcaattggaaagcatgctttttcatcctagggaatgaatgttgtgaaaggctggcctactacggaattgcaaaaaacctagttacttatttgaaagtgaagcttcatctaggcaacctcgaggctgcaagacatgttaccacttggcaagggacatgctatctcactccccttgttggaggcatcttagcagactctcgttgggggaaatactggactattgctgttttctcatcggtttactttattggcctggctattttaacgctttctgcatcagtcccagcgttgcaaccaccttcatgtttaaggacagtttgtccagaagcaagcttacttcagtatggcatattttttggtggcctctatatgattgccctagggactggaggtatcaaaccttgtgtctcctcctttggagctgatcaatttgatgacactgaccaagcagagagagctaagaagggttcattcttcaattggttctacttctgtataaatatagtttcattcatatcaggcactatgatagtgtggatacaagataacactggttggggaataggctttgcgattcctactatattcatggcattagctatttcattcttcttctcagcttcaaataagtacagattccaaaaacctggtgggagtccactcacaagagtgtgccaggtggttatagcagcatttcgtaagtggcacattgaagtgccacatgatacatctctcctatatgaagttgatggccaaacttcagcaattgaaggaagccggaagctggagcacacaaatgagctcgagttccttgatagagctgctgttatctcatctgctgatctgaagagtgaatcctttaccgacccatggaagctttgcacagttacccaggtggaagaattgaagatcctaataagaatgtttcccatttgggctactactatcatattcagtgctgtttatgcccaaaactcttccatgttcatagagcagggcatggttcttgacaagcgcattgggtctttcaacattcctcctgcatctctctccacttttgatgtaatcagcgtcatcatgtgggtcccactctatgaccgcatcctggtgccactagctagaaaattcactggaagggagaagggtttttctgagctacagcggatgggaattggattagtcctgtccattctcgcgatgttatctgcagctctagttgagttgaagcgtttagagattgccaggtctgaaggtctcattcatgagaaggctgctgttccaatgagcattctttggcaaataccacaatatttcttggtgggcgctgctgaggtgtttacttgtattggtcaagttgagttcttttacgatcaggccccagatgccatgaggagtttatgtagtgcacttgcacttattacagtctcactgggaaactatataagctccatcatactgacattggtgtcgtacattacaactcagggaggagatcctggatggatccctgacaatctgaatgaaggccatctcgaccggttcttttggttaattgcagggataagctttgtaaatttgatagtttatatgggttgtgctgtcagatacagatataagaaagcctcttgattatatttatgtgaactcttgtaatgtgatttcccattcccgatatcatacttatcaaatacaatgcactgtacagatttct

SEQ ID NO: 492 - protein, 592 aa, Zea mays
  misc_feature (121)..(525): Pfam Name: PTR2 Pfam Description: POT family
  misc_feature: Ceres Clone ID no. 325604
  misc_feature: Bit score of 1162.3 for HMM based on sequences of Figure 11
  misc_feature: Functional Homolog Of SEQ ID NO. 426
MDEAAGLLLQEEGGGGDQEALLLPLPQDVGLYTGDGSVDVKGRPALKGTTGNWKACFFILGNECCERLAYYGIAKNLVTYLKVKLHLGNLEAARHVTTWQGTCYLTPLVGGILADSRWGKYWTIAVFSSVYFIGLAILTLSASVPALQPPSCLRTVCPEASLLQYGIFFGGLYMIALGTGGIKPCVSSFGADQFDDTDQAERAKKGSFFNWFYFCINIVSFISGTMIVWIQDNTGWGIGFAIPTIFMALAISFFFSASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPIWATTIIFSAVYAQNSSMFIEQGMVLDKRIGSFNIPPASLSTFDVISVIMWVPLYDRILVPLARKFTGREKGFSELQRMGIGLVLSILAMLSAALVELKRLEIARSEGLIHEKAAVPMSILWQIPQYFLVGAAEVFTCIGQVEFFYDQAPDAMRSLCSALALITVSLGNYISSIILTLVSYITTQGGDPGWIPDNLNEGHLDRFFWLIAGISFVNLIVYMGCAVRYRYKKAS

SEQ ID NO: 493 - protein, 621 aa, Oryza sativa subsp. japonica
  misc_feature (150)..(552): Pfam Name: PTR2 Pfam Description: POT family
  misc_feature: Public GI ID no. 108707040
  misc_feature: Bit score of 1063.1 for HMM based on sequences of Figure 11
  misc_feature: Functional Homolog Of SEQ ID NO. 426
MEGVLLQQELPKKQFKAEHLSSWRVQQPFRAAKGAFMGSSLEAEQQSLIVRTTEPEDVDDYTGDGSVGFSGQPILKHETGNWRACSLILGTEVCERLAYYGISKSLVTYLSTRLHEGNVSAARNFTTWQGTCYLTPLIGATLADSYWGKYKTIAVFSTIYFLGMAALTFSALVPSLQPPQCFGSFCPQPTVPQYLIYFVGLYMIALGSGGIKPCVSSFGADQFDDTDPVERTKKGAFFNWFYFAINIGSLISGTVLIWVQQNCGYGIGFGIPTIFIALAIGSFFIGSQRYRYQIPGGSPLIRVCQVVIAAIHKRNVDLPVDSSVLYELHGKTSAIEGSRKLEHSSEFSFLDKAAVILSNERGGSHDPWRLCTITQVEELKILMRMFPIWATGIVFFTVCAQNSSMFIEQGMALNNQIESFKIPPATLSSLDVISIVVWVPIYETFVVPIASRLTGKERGFSELQRMGIGLFVATTAVATAALVEIKRLEIARSEDLIHSKVPVPMSILWQAPQYLLVGIGEVFTAIGQAEFFYNQSPDSMRSLCSAFALVTVSLGSYLSSFILTLVSYFTTRDDNPGWIPDNLNEGHLDRFFWLIAGLSFLNLLLFVYYAQQYKCKKAAAI

SEQ ID NO: 494 - DNA, 1845 bp, Arabidopsis thaliana
  misc_feature: Ceres Annot ID no. 1302517
  misc_feature: Encodes the peptide sequence at SEQ ID NO. 495
atgtcttgcctagagatttataacaaagacacgatgaagaagaaagaaggagaagaagaaacaagagatgggacagtggattactatggtcgtccctctattcgttctaactcaggccaatgggttgctggcatcgtcattcttctgaaccaggggctggctacactagccttctttggagttggagtgaacttggtgctcttcctaactcgcgttttgcagcagaacaacgcagacgcagctaacaacgttagcaaatggacagggactgtttatatcttctcattggttggagcgtttctcagcgattcgtattggggtcgttacaagacttgtgctatcttccaagtcatttttgtcattggactttcatcgctatcgctatcatcatacatgttcttgattagaccaagaggttgtggggacgaagtcacgccttgtggttcacattccatgatggagatcacaatgttctacttctcgatctacttgatcgcattgggatatggcggttaccaaccaaacattgcaacgcttggagcggatcagttcgatgaggagcatcctaaagaagggtactcgaagattgcgtttttcagctacttttaccttgctttaaacctcggatcgctcttttcgaacaccatcttggggtattttgaggatgagggaatgtgggcactcgggttttgggcatccactggctctgctatcattgggttgattcttttccttgttggaacaccgagataccgatatttcaagcccacggggaatcctctttcgaggttttgccaagttttggtcgctgcaacgaagaaatcatcggtggaggcaccattaagagggagagaggagatgtatgacggagacagcgaagggaaaaatgcttcagttaacacagggagaaggatagtgcataccgatgaattcaagttcttggacaaagcagcgtacatcacagctagagatctagatgacaagaaacaagactcagtgaacccatggaggctctgtccagtgacacaagtcgaggaagtcaagtgtattcttagactgatgccaatttggctctgcactataatctactcagtcgtcttcactcaaatggcctctctctttgtggagcaaggcgctgcaatgaatacctctgtctcagatttcaaaatccccccggcaagtatgtccagcttcgacatccttagcgtcgctttgttcatattcctgtaccgcagagttctcgagccagtagccaacagattcaaaaagaatggatcaaaaggaatcaccgagcttcacaggatgggaatcggacttgtgattgctgtcatagctatgattgcagccgggattgtggaatgctataggcttaagtatgcagacaagagttgtactcactgtgatggctcaagctccttaagcatcttctggcaggctccacaatactcactcatcggggcatcagaagtgttcatgtacgtgggtcagcttgagttcttcaacgcgcaaacaccagacggactaaagagcttcgggagcgctctgtgtatgatgtcaatgtcaatggggaactttgttagtagcttgttggtaacaatggtggtgaagatctcaacagaggatcacatgcctggttggattccaaggaatctcaacaaaggtcacttagacagattctatttcctcctggctgcgttgacgagcattgacctggtggtatacattgcatgtgcaaaatggtacaaacctatacaactagaaggaaaagatgagatgcaagacatgagtgatgatgactatgacaccgagagtgaagaggaacgagagaaggattctaaagtctaa

SEQ ID NO: 495 - protein, 614 aa, Arabidopsis thaliana
  misc_feature (109)..(520): Pfam Name: PTR2 Pfam Description: POT family
  misc_feature: Ceres Annot ID no. 1302517
  misc_feature: Bit score of 1239.2 for HMM based on sequences of Figure 11
  misc_feature: Functional Homolog Of SEQ ID NO. 426
MSCLEIYNKDTMKKKEGEEETRDGTVDYYGRPSIRSNSGQWVAGIVILLNQGLATLAFFGVGVNLVLFLTRVLQQNNADAANNVSKWTGTVYIFSLVGAFLSDSYWGRYKTCAIFQVIFVIGLSSLSLSSYMFLIRPRGCGDEVTPCGSHSMMEITMFYFSIYLIALGYGGYQPNIATLGADQFDEEHPKEGYSKIAFFSYFYLALNLGSLFSNTILGYFEDEGMWALGFWASTGSAIIGLILFLVGTPRYRYFKPTGNPLSRFCQVLVAATKKSSVEAPLRGREEMYDGDSEGKNASVNTGRRIVHTDEFKFLDKAAYITARDLDDKKQDSVNPWRLCPVTQVEEVKCILRLMPIWLCTIIYSVVFTQMASLFVEQGAAMNTSVSDFKIPPASMSSFDILSVALFIFLYRRVLEPVANRFKKNGSKGITELHRMGIGLVIAVIAMIAAGIVECYRLKYADKSCTHCDGSSSLSIFWQAPQYSLIGASEVFMYVGQLEFFNAQTPDGLKSFGSALCMMSMSMGNFVSSLLVTMVVKISTEDHMPGWIPRNLNKGHLDRFYFLLAALTSIDLVVYIACAKWYKPIQLEGKDEMQDMSDDDYDTESEEEREKDSKV

SEQ ID NO: 496 - DNA, 1830 bp, Arabidopsis thaliana
  misc_feature: Ceres Annot ID no. 1355964
  misc_feature: Encodes the peptide sequence at SEQ ID NO. 497
atggccgctatggatccgagaaataatggcaacgttgctccgctaaatgagcgggagagagcagaaaatttggaagttcgtgaagtggtagaggttcaagatgatcaaagtgtggtgtctcttatgtccaacgattctgaccttcagaaaaagatgatgaagaaagaggagaagaagaatggtggctggacaaacgcaatcattttgctagtaaatcaagggttagctacattggccttctttggtgtgggagtaaacttggtgttgttcctaacacgtgttatgggacaaggtaatgcagaagctgcgaacaatgtaagcaagtggacaggaacagtttacatgttctctctcgttggggcatttcttagtgactcctattggggtcgttacttgacttgcacgatattccaagtcatcttcgttatcggtgttggcctcctctcttttgtctcttggtttttcttgattaaacctcgaggatgtggcgatggggaccttgaatgcaaccctccctcttccctcggagttgctatcttttatctatctgtatatttggtagcttttggatacggaggccaccagccaacgctggctactttcggtgcagaccagcttgatgatgataaaaactccaaagctgcgtttttcagctacttctactttgctctcaacgtgggagctctcttttcaaacacaatccttgtttattttgaggataaagggttgtggactgaaggtttcttggtgtcactaggctccgctattgtcgcattggtggcttttttggccccaacaagacaatatcgttatgtcaagccgtgtggtaacccgttgcctcgtgtggcgcaagtatttgtggccactgctcgtaagtggagtgttgttcgaccaggagatccgcatgagttgtacgaacttgaaggtcctgaatccgccattaaaggaagtcgaaagatatttcatagtaccaaatttctcttcttggatagagcagcagtgattacagagaatgataggaatgggacaaggagcaatgcatggaggttgtgcagtgtaactcaagtagaggaggcaaaatgtgtgatgaagttgcttccaatatggctatgcactataatctactcagtgatcttcacacaaatggcgtcattgtttgtggagcaaggtgatgtgatgaatgcatacgtagggaaattccacatccccgcagcgagcatgtcggtcttcgacatattcagcgtctttgtatcaacaggaatctaccgccacatcatatttccatacgtgagacccacggaacttatgcggatggggatagggctgatcatagggataatggcaatggtagctgcaggattaacagagatccaacggctgaaacgagtagtcccggggcaaaaggagagtgagctcaccattttatggcaaattccacagtacgtgcttgtgggagcaagtgaggtgttcatgtacgttggacagttagagttcttcaacggacaagcaccagacgggttaaagaacttaggaagctcgttgtgtatggcttcgatggctttaggtaactacgtgagcagtttgatggttaatattgttatggccataaccaaaagaggtgagaatagccccgggtggataccggaaaatctcaacgaaggtcatatggatcggttttattttctgattgccgcgttagcagctatcgattttgtggtttatttgatatttgcaaagtggtaccaacccataagtcatgatgaagatagtatcaagggcggttctggtggtagtctgaagaagaccgtttctgagttggaacaagtttga

SEQ ID NO: 497 - protein, 609 aa, Arabidopsis thaliana
  misc_feature (131)..(519): Pfam Name: PTR2 Pfam Description: POT family
  misc_feature: Ceres Annot ID no. 1355964
  misc_feature: Bit score of 1088.7 for HMM based on sequences of Figure 11
  misc_feature: Functional Homolog Of SEQ ID NO. 426
MAAMDPRNNGNVAPLNERERAENLEVREVVEVQDDQSVVSLMSNDSDLQKKMMKKEEKKNGGWTNAIILLVNQGLATLAFFGVGVNLVLFLTRVMGQGNAEAANNVSKWTGTVYMFSLVGAFLSDSYWGRYLTCTIFQVIFVIGVGLLSFVSWFFLIKPRGCGDGDLECNPPSSLGVAIFYLSVYLVAFGYGGHQPTLATFGADQLDDDKNSKAAFFSYFYFALNVGALFSNTILVYFEDKGLWTEGFLVSLGSAIVALVAFLAPTRQYRYVKPCGNPLPRVAQVFVATARKWSVVRPGDPHELYELEGPESAIKGSRKIFHSTKFLFLDRAAVITENDRNGTRSNAWRLCSVTQVEEAKCVMKLLPIWLCTIIYSVIFTQMASLFVEQGDVMNAYVGKFHIPAASMSVFDIFSVFVSTGIYRHIIFPYVRPTELMRMGIGLIIGIMAMVAAGLTEIQRLKRVVPGQKESELTILWQIPQYVLVGASEVFMYVGQLEFFNGQAPDGLKNLGSSLCMASMALGNYVSSLMVNIVMAITKRGENSPGWIPENLNEGHMDRFYFLIAALAAIDFVVYLIFAKWYQPISHDEDSIKGGSGGSLKKTVSELEQV

SEQ ID NO: 498 - DNA, 1758 bp, Arabidopsis thaliana
  misc_feature: Ceres Annot ID no. 8755104
  misc_feature: Encodes the peptide sequence at SEQ ID NO. 499
atggccgctatggatccgagaaataatggcaaccgggagagagcagaaaatttggaagttcgtgaagtggtagaggttcaagatgatcaaagtgtggagaagaagaatggtggctggacaaacgcaatcattttgctagtaaatcaagggttagctacattggccttctttggtgtgggagtaaacttggtgttgttcctaacacgtgttatgggacaaggtaatgcagaagctgcgaacaatgtaagcaagtggacaggaacagtttacatgttctctctcgttggggcatttcttagtgactcctattggggtcgttacttgacttgcacgatattccaagtcatcttcgttatcggtgttggcctcctctcttttgtctcttggtttttcttgattaaacctcgaggatgtggcgatggggaccttgaatgcaaccctccctcttccctcggagttgctatcttttatctatctgtatatttggtagcttttggatacggaggccaccagccaacgctggctactttcggtgcagaccagcttgatgatgataaaaactccaaagctgcgtttttcagctacttctactttgctctcaacgtgggagctctcttttcaaacacaatccttgtttattttgaggataaagggttgtggactgaaggtttcttggtgtcactaggctccgctattgtcgcattggtggcttttttggccccaacaagacaatatcgttatgtcaagccgtgtggtaacccgttgcctcgtgtggcgcaagtatttgtggccactgctcgtaagtggagtgttgttcgaccaggagatccgcatgagttgtacgaacttgaaggtcctgaatccgccattaaaggaagtcgaaagatatttcatagtaccaaatttctcttcttggatagagcagcagtgattacagagaatgataggaatgggacaaggagcaatgcatggaggttgtgcagtgtaactcaagtagaggaggcaaaatgtgtgatgaagttgcttccaatatggctatgcactataatctactcagtgatcttcacacaaatggcgtcattgtttgtggagcaaggtgatgtgatgaatgcatacgtagggaaattccacatccccgcagcgagcatgtcggtcttcgacatattcagcgtctttgtatcaacaggaatctaccgccacatcatatttccatacgtgagacccacggaacttatgcggatggggatagggctgatcatagggataatggcaatggtagctgcaggattaacagagatccaacggctgaaacgagtagtcccggggcaaaaggagagtgagctcaccattttatggcaaattccacagtacgtgcttgtgggagcaagtgaggtgttcatgtacgttggacagttagagttcttcaacggacaagcaccagacgggttaaagaacttaggaagctcgttgtgtatggcttcgatggctttaggtaactacgtgagcagtttgatggttaatattgttatggccataaccaaaagaggtgagaatagccccgggtggataccggaaaatctcaacgaaggtcatatggatcggttttattttctgattgccgcgttagcagctatcgattttgtggtttatttgatatttgcaaagtggtaccaacccataagtcatgatgaagatagtatcaagggcggttctggtggtagtctgaagaagaccgtttctgagttggaacaagtttga

SEQ ID NO: 499 - protein, 585 aa, Arabidopsis thaliana
  misc_feature (107)..(495): Pfam Name: PTR2 Pfam Description: POT family
  misc_feature: Ceres Annot ID no. 8755104
  misc_feature: Bit score of 1097.7 for HMM based on sequences of Figure 11
  misc_feature: Functional Homolog Of SEQ ID NO. 426
MAAMDPRNNGNRERAENLEVREVVEVQDDQSVEKKNGGWTNAIILLVNQGLATLAFFGVGVNLVLFLTRVMGQGNAEAANNVSKWTGTVYMFSLVGAFLSDSYWGRYLTCTIFQVIFVIGVGLLSFVSWFFLIKPRGCGDGDLECNPPSSLGVAIFYLSVYLVAFGYGGHQPTLATFGADQLDDDKNSKAAFFSYFYFALNVGALFSNTILVYFEDKGLWTEGFLVSLGSAIVALVAFLAPTRQYRYVKPCGNPLPRVAQVFVATARKWSVVRPGDPHELYELEGPESAIKGSRKIFHSTKFLFLDRAAVITENDRNGTRSNAWRLCSVTQVEEAKCVMKLLPIWLCTIIYSVIFTQMASLFVEQGDVMNAYVGKFHIPAASMSVFDIFSVFVSTGIYRHIIFPYVRPTELMRMGIGLIIGIMAMVAAGLTEIQRLKRVVPGQKESELTILWQIPQYVLVGASEVFMYVGQLEFFNGQAPDGLKNLGSSLCMASMALGNYVSSLMVNIVMAITKRGENSPGWIPENLNEGHMDRFYFLIAALAAIDFVVYLIFAKWYQPISHDEDSIKGGSGGSLKKTVSELEQV

SEQ ID NO: 500 - protein, 568 aa, Vitis vinifera
  misc_feature (96)..(497): Pfam Name: PTR2 Pfam Description: POT family
  misc_feature: Public GI ID no. 147802380
  misc_feature: Bit score of 1155.1 for HMM based on sequences of Figure 11
  misc_feature: Functional Homolog Of SEQ ID NO. 426
MAEDDMYTKDGTMNIHNKPANKKKTGQWKACRFILGNECCERLAYYGMSTNLVNYLQIRLNQGNVTASNNVTNWSGTCYITPLIGAFLADAYFGRFWIIAIFSIIYFCGMVLLTMTASIKGLRPSCDDNGCDPTKLQSAVCFIALYLIALGTGGIKPCVSSFGADQFDVNDEAEKKKKSSFFNWFYLSINVGALIASSVLVWIQMNVGWGWGFGIPAVAMAIAVVSFFSGSRMYRLQKPGGSPLTRICQVLVASTRKYHVKVPNNKSLLYETKDAESNIKGSCKLEHTEKLRFFDKAAVEVESDHVKSSNNPWKLCTVTQVEELKSILRLLPVWATGILFSTVYSQMSTMFVLQGNTMDQHMGPNFKIPSASLSLFDTLSVIFWAPVYDRIIVPFARKFTGHERGFTQLQRMGIGLVISIISMIVAGILEVIRLNYVRKHNYYDLEYIPMSIFWQVPQYFLIGCAEVFTFIGQLEFYYDQAPDATRSLCSALSLTTNALGNYLSTLLVTIVNKVTTRNGKMGWIPDNMNRGHLDYFYWLLAILSLLNFLVYLWIAKWYTYKKVTGRPG

SEQ ID NO: 501 - protein, 586 aa, Arabidopsis thaliana
  misc_feature (113)..(518): Pfam Name: PTR2 Pfam Description: POT family
  misc_feature: Public GI ID no. 510238
  misc_feature: Bit score of 1169.8 for HMM based on sequences of Figure 11
  misc_feature: Functional Homolog Of SEQ ID NO. 426
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWEDLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 502 - protein, 603 aa, Vitis vinifera
  misc_feature (120)..(528): Pfam Name: PTR2 Pfam Description: POT family
  misc_feature: Public GI ID no. 157341962
  misc_feature: Bit score of 1310.8 for HMM based on sequences of Figure 11
  misc_feature: Functional Homolog Of SEQ ID NO. 426
MKKKAEYINFWLEFAYYLSFQVKFKAGEEACTLDGTVDCRGNPAIRSRSGKWFAGIIILLNQGLATLAFFGVGVNLVLFLTRVLQQNNADAANNVSKWTGTVYIFSLVGAFLSDSYWGRYKTCAIFQVIFVIGLVSLSLSSYIFLVKPEGCGNEDSPCPSHSSLEIGLFYLSIYLVALGNGGYQPNIATLGADQFDEEDPKEGHSKVAFFSYFYLALNLGSLFSNTILSYLEDEGMWALGFWVSAGSAFLALILFLGGTPRYRHFKPSGNPLSRFCQVMVAAMRKFRVEMPPSAEDLYEGDGKECSNNSIRRILHTDGFKFLDRAAFISSKDSDNQEQGFYNQWRLCPITQVEEVKCILRLIPIWLCTIIYSVVFTQMASLFVEQGAAMKTTVSNFRIPPASMSSFDILSVAAFIFLYRRVLDPLVGRIRKTDTKGLTELQRMGIGLIIAIIAMIAAGIVECYRLKYAQKDCTNCEGSSSLSIFWQVPQYAFIGASEVFMYVGQLEFFNAQTPDGLKSFGSALCMTSISLGNYVSSLLVTMVMKISTEDHMPGWIPGNLNKGHLDRFYFLLATLTALDLVVYVACAKWYKCIKMEDRANEYGV

SEQ ID NO: 503 - protein, 559 aa, Prunus dulcis
  misc_feature (113)..(517): Pfam Name: PTR2 Pfam Description: POT family
  misc_feature: Public GI ID no. 6635838
  misc_feature: Bit score of 1117.9 for HMM based on sequences of Figure 11
  misc_feature: Functional Homolog Of SEQ ID NO. 426
  misc_feature (46)..(46): Xaa is any aa, unknown, or other
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 504 - protein, 576 aa, Arabidopsis thaliana
  misc_feature (87)..(496): Pfam Name: PTR2 Pfam Description: POT family
  misc_feature: Public GI ID no. 4455276
  misc_feature: Bit score of 1251.8 for HMM based on sequences of Figure 11
  misc_feature: Functional Homolog Of SEQ ID NO. 426
MDQKVRQFEVCTQDGSVDRHGNPAIRANTGKWLTAILILGVNLVLFLTRVMGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 505 - DNA, 1779 bp, Sorghum bicolor
  misc_feature: Ceres Annot ID no. 8642246
  misc_feature: Encodes the peptide sequence at SEQ ID NO. 506
atggatgaggcaccagggctgctgttgcaagaagagggtggaggtagggaccacgaaccgctcctccttccacttccacaggatgctggcctttacacaggtgatggatctgttgatgtcaaagggtgtcctgcattaaagggcactacaggcaattggaaagcatgttttttcatcctagggaatgagtgttgtgaaaggctggcctactacggaattgcaaaaaacctagttacttatttgaaagtgaagcttcatctaggcaaccttgaggctgcaagacatgttaccacttggcaagggacatgctatcttactccccttgttggagccatcttagcagattctcattgggggaaatactggacaattgctgttttctcatcagtttactttattggcctggctattttgacgctgtcagcatcagtcccagcattgcagccaccttcatgtttaagaacagtttgtccagaagcaagcttacttcagtatggcgtattttttgttggtctctatatgatagccctagggacaggaggtatcaaaccttgtgtctcctcctttggagctgatcaatttgatgacactgacccagcagagagagctaagaagggctccttcttcaattggttctacttctgtataaatattggtgcattcatatcaggcactatcatagtgtggatacaagataacactggttggggaataggatttgcaattcctactatattcatggcattagctatttcattcttcctcacagcttcaaataagtacagattccaaaaacctggtgggagtccactcacaagagtgtgccaggtagttatagcagcatttcgtaagtggcacattgaagtgccacatgatacatctctcctctatgaagttgatggccaaacttcagcaattgagggaagccggaagctggagcacacaaatgagctcgagttccttgatagagctgccgttatctcatctgctgacctgaagagcgaatcctttacagacccatggaagctttgcacagttacccaggtggaagaattgaagattctaataagaatgtttcccgtttgggctactactatcatattcagtgctgtttacgcccaaaactcttccatgttcatagagcagggcatggttcttgacaagcgcattggatctttcaatattcctcctgcatctctctcaacttttgatgtaatcagcgtcatcatatgggttccactttatgaccgcattctggtgccagtagctagaaaattcactggaagggagaagggtttttctgagctccagcggatgggaattggattagccctgtcaattcttgcgatggtatctgcagctcttgttgagttgaagcgtttagagattgccaggtctgaaggtcttattcatgagaaggctgctgttccaatgagcattctttggcaaataccacaatatttcttggtgggtgctgctgaggtgtttacttgtataggtcaagtcgagttcttttacgatgaggccccagatgccatgaggagtttatgtagtgcatttgcacttattacagtctcactgggaagctatataagctccatcatactgacgttggtgtcgtgcattacaactcagggaggagatcctggatggatccctgacaatctgaatgaaggccatctcgaccggttcttttggttaattgctgggataagctttgtgaatttgatagtttacatgggctgtgctgtgagatacagatataagaaagcctcttga

SEQ ID NO: 506 - protein, 592 aa, Sorghum bicolor
  misc_feature (121)..(525): Pfam Name: PTR2 Pfam Description: POT family
  misc_feature: Ceres Annot ID no. 8642246
  misc_feature: Bit score of 1164.3 for HMM based on sequences of Figure 11
  misc_feature: Functional Homolog Of SEQ ID NO. 426
MDEAPGLLLQEEGGGRDHEPLLLPLPQDAGLYTGDGSVDVKGCPALKGTTGNWKACFFILGNECCERLAYYGIAKNLVTYLKVKLHLGNLEAARHVTTWQGTCYLTPLVGAILADSHWGKYWTIAVFSSVYFIGLAILTLSASVPALQPPSCLRTVCPEASLLQYGVFFVGLYMIALGTGGIKPCVSSFGADQFDDTDPAERAKKGSFFNWFYFCINIGAFISGTIIVWIQDNTGWGIGFAIPTIFMALAISFFLTASNKYRFQKPGGSPLTRVCQVVIAAFRKWHIEVPHDTSLLYEVDGQTSAIEGSRKLEHTNELEFLDRAAVISSADLKSESFTDPWKLCTVTQVEELKILIRMFPVWATTIIFSAVYAQNSSMFIEQGMVLDKRIGSFNIPPASLSTFDVISVIIWVPLYDRILVPVARKFTGREKGFSELQRMGIGLALSILAMVSAALVELKRLEIARSEGLIHEKAAVPMSILWQIPQYFLVGAAEVFTCIGQVEFFYDEAPDAMRSLCSAFALITVSLGSYISSIILTLVSCITTQGGDPGWIPDNLNEGHLDRFFWLIAGISFVNLIVYMGCAVRYRYKKAS

SEQ ID NO: 507 - DNA, 1764 bp, Sorghum bicolor
  misc_feature: Ceres Annot ID no. 8633032
  misc_feature: Encodes the peptide sequence at SEQ ID NO. 508
atggccggcgccgagcgcgcggaggcggtcgctctggaggaagggctcctcgctccggaggaatccaaccaagtagtatacactggagatggatcagtcgacttttcgggaaatcctgttgtcaaggaaacaacgggtagatggaaggcatgtccattcatattaggtaatgaatgctgtgaacgactggcctattatggcatctccacgaaccttgtcacttacttgacaaaaaagctacatgctggcaatgcctctgctgctagcaatgtgactacatggcagggaacttgctacttgactccgcttattggggcaatcctggctgatgcatactgggggaggtattggacgattgcaacattctccacagtatacttcatcgggatgtcaatactgactctttcagcatcagttcctatgctcatgcctccatcttgtgaaggatccttttgcccacaagcaagcccttttcagtatactgtatttttccttggtctttatctgattgccctgggtactggtggaattaagccttgtgtctcatcctttggagcggatcaatttgatgatacagatccagctgagcgaatccagaagggttctttctttaattggttctatttttcaataaacattggtgctctcatatcaagcagctttctggtttgggtgcaagacaatgtaggatggggactgggctttggcattccgactgtattcatggggctggcaatcataagtttcttctctggcacatcactttataggttccaaaaaccaggaggtagtcctattacacgagtatgccaggtgattgttgcctctttgcgcaagtggaatgtgcctgccccagaggacagctctctcttgtatgagctacctaatggggtatcaacaattgaggggagtcggcaaatagagcacacagatgaactcagatgtttagacaaggctgctacagttaccgaagttgatgtgaaaatggctgacttcagcaacccatggcggatatgcactgtcacccaggtggaagaactgaagatactagtaaggatgttccctgtctgggcaacaacaatagtgttttctgctgtatatgctcaaatgtcgacaatgttcgtggaacaagggatggtgcttgacccatcgttgggttctttcaagattcctccagcttcactgtctacctttgacaccctaagtgtcatcgtatgtgtcccgatgtacgattacattgtggttccaatagccaggagattcaccggcaacgagaggggctttacagagttgcagaggatgggcattggcctggtcatttccatccttgctatgtcggtcgctgcaatcctcgaaatcaagcggctagcagttgccagggaagcacacctggtggatcagaatgtcccggtcccactgagcatattctggcaaatccctcagtatttcctgattggtctagcagagattttcacattcatcggagcgcttgagttcttttatgaccagtcaccagacgccatgaggagcctctgcagtgcacttaatcttctcactactgcgggtgggaactatctcagcacgttcattttgacaatggtcgcgtactttactacgaggggaggtaaccctggatggattcctgacaacttgaacgaagggcatcttgattacttcttctggctccttgctggcctcagttttctgaacctgattgtatatgtcatctgtgctggcaaatacaagggcaagaaggcagcttga

SEQ ID NO: 508 - protein, 587 aa, Sorghum bicolor
  misc_feature (116)..(520): Pfam Name: PTR2 Pfam Description: POT family
  misc_feature: Ceres Annot ID no. 8633032
  misc_feature: Bit score of 1219.7 for HMM based on sequences of Figure 11
  misc_feature: Functional Homolog Of SEQ ID NO. 426
MAGAERAEAVALEEGLLAPEESNQVVYTGDGSVDFSGNPVVKETTGRWKACPFILGNECCERLAYYGISTNLVTYLTKKLHAGNASAASNVTTWQGTCYLTPLIGAILADAYWGRYWTIATFSTVYFIGMSILTLSASVPMLMPPSCEGSFCPQASPFQYTVFFLGLYLIALGTGGIKPCVSSFGADQFDDTDPAERIQKGSFFNWFYFSINIGALISSSFLVWVQDNVGWGLGFGIPTVFMGLAIISFFSGTSLYRFQKPGGSPITRVCQVIVASLRKWNVPAPEDSSLLYELPNGVSTIEGSRQIEHTDELRCLDKAATVTEVDVKMADFSNPWRICTVTQVEELKILVRMFPVWATTIVFSAVYAQMSTMFVEQGMVLDPSLGSFKIPPASLSTFDTLSVIVCVPMYDYIVVPIARRFTGNERGFTELQRMGIGLVISILAMSVAAILEIKRLAVAREAHLVDQNVPVPLSIFWQIPQYFLIGLAEIFTFIGALEFFYDQSPDAMRSLCSALNLLTTAGGNYLSTFILTMVAYFTTRGGNPGWIPDNLNEGHLDYFFWLLAGLSFLNLIVYVICAGKYKGKKAA

SEQ ID NO: 509 - protein, 570 aa, Vitis vinifera
  misc_feature (87)..(485): Pfam Name: PTR2 Pfam Description: POT family
  misc_feature: Public GI ID no. 157337654
  misc_feature: Bit score of 1166.2 for HMM based on sequences of Figure 11
  misc_feature: Functional Homolog Of SEQ ID NO. 426
MMGAFQFQGFITGNATGGWKSASLLLANQGLATLAFFGVGVNLVLFLTRVLSQDNANAANSVSKWTGTVYLCSLIGAFLSDSYWGRYLTCAIFQVILVLGLLLLSLSSWLFLIEPKGCGDRTTLCSPSSSVGLGVFYSSIYLVAFGYGGHQPTLATLGADQFDETNPREMNSKTVFFSYFYFALNLGSLFSNTILVYFEDSGKWTLGFLVSTGSAIIALVIFLCGSSGYRHIKPCGNPLPRVAQVFVAAFRKWDVVVPENGDGLYELEGSESAIKGSRKILHSNEIEFLDKAATMIEADMVDPNPWRLCTVTQVEEAKCVIKMLPIWLCTIIYSVIFTQMASLFVEQGDVMNRKIGNFEIPAASMSAFDIFSVLLCTGIYRQILVPISGKLTGNPKGMSELQRMGIGLIIGIAAMIAAGLTELGRLRRVSPNEEASSLSIFWQTPQYVLVGASEVFMYVGQLEFFNGQAPDGIKSLGSSLCMASISLGNYVSSLLVNIVMGVTTRGDNPGWIPEDLNTGHLDRFYFLIAVLTVIDFVIYVFCAKWYKSINLESFEKKKDQEDGHAVDEGK

SEQ ID NO: 510 - DNA, 1770 bp, Sorghum bicolor
  misc_feature: Ceres Annot ID no. 8642241
  misc_feature: Encodes the peptide sequence at SEQ ID NO. 511
atggagtcatcgctggaggaggagcggcggcagaacctgctgctgcgcgcgacggagccgccagaggatcttgccgttgccgggtacacaggtgatggatcagttgactttagaggttttcctattttaaagcataacacagggaactggagagcatgttcattgattcttggaactgaaatatgtgaacgtttggcctactatggaatctcaaaaagtttggtcacttacctttcaacaaggctacatgaaggaaatgtctctgctgcgaggaacttcacaacctggcaaggaacttgttatcttacaccacttattggagcaaccttagcagattcgtactggggaaagtacaggactattgctgttttctccactatttactttcttgggatggcggcattgacactttcagcatcagttccttctttccagccccctcaatgtgttgggtctatttgtccacaaccgaccttacctcagtaccttatatactttgttggattatacatgattgctttgggagctggtggtataaagccatgtgtttcgtcctttggggctgaccaattcgatgatactgatccagttgagaaaacaaagaaaggcgctttcttcaattggttttatttctgcataaatattggttctttgatctctggcacagttcttatttgggtacaagagaattatggatatggcattggatttgggatccctacttttttcattgccttggctattggaagcttttttataggttcagaaaggtatagatttcagataccgggaggaagcccacttacaagagcatgtcaggtagttgtggcagccactcacaagcgaaaagcggatttgccagttgacagttctcttctctatgagctagatggtaagacttcagctattgaggggagtcgtaagctggagcacagtagtgaattcagtttccttgacaaagctgcagtcgttttgtggaatgaacatgatggttctcgcaatccatggagactttgcacagtcacacaagttgaagagcttaaaatattactgaggatgtttccaatctgggcaacaggaattgtgttcttcaccgtatgtgctcaaaactcatcgatgttcatagaacaagggatggccctcgataaccaaattggttctttcaagattccagcagcaactctgtcatccctagatgttatcagtattgttgtttgggttccaatttatgagagattagttgtgcccatagccaggagattcagtggaaaagagagaggtttctcagaacttcaacggatgggaattggtctatttgtatctacagttgcagtggcagttgcagcattagtcgagatcaagcgtctgcaggtcgcaagagcagaggatctggttcatcagaaggtacctgttcctatgagcatcctttggcaagcaccacagtacttgctggttggcgtgggcgaggtgttcacatcaatcggtcaagctgagtttttctacaatcagtcaccagacgccatgagaagcctatgctcagctttcgctcttgttaccgtgtcacttggaagttatctcagctcattcatcttgaccctggtgtcatatttcacaactcgaaatgggcaattggggtggatccctgataacttaaacgaaggccatcttgaccgttttttctggctgatagctggtctcagctctttaaatttccttgtttttatatattacgctcaacaatacaagtgcaagagagcctctgttgcttaa

SEQ ID NO: 511 - protein, 589 aa, Sorghum bicolor
  misc_feature (118)..(520): Pfam Name: PTR2 Pfam Description: POT family
  misc_feature: Ceres Annot ID no. 8642241
  misc_feature: Bit score of 1075.0 for HMM based on sequences of Figure 11
  misc_feature: Functional Homolog Of SEQ ID NO. 426
MESSLEEERRQNLLLRATEPPEDLAVAGYTGDGSVDFRGFPILKHNTGNWRACSLILGTEICERLAYYGISKSLVTYLSTRLHEGNVSAARNFTTWQGTCYLTPLIGATLADSYWGKYRTIAVFSTIYFLGMAALTLSASVPSFQPPQCVGSICPQPTLPQYLIYFVGLYMIALGAGGIKPCVSSFGADQFDDTDPVEKTKKGAFFNWFYFCINIGSLISGTVLIWVQENYGYGIGFGIPTFFIALAIGSFFIGSERYRFQIPGGSPLTRACQVVVAATHKRKADLPVDSSLLYELDGKTSAIEGSRKLEHSSEFSFLDKAAVVLWNEHDGSRNPWRLCTVTQVEELKILLRMFPIWATGIVFFTVCAQNSSMFIEQGMALDNQIGSFKIPAATLSSLDVISIVVWVPIYERLVVPIARRFSGKERGFSELQRMGIGLFVSTVAVAVAALVEIKRLQVARAEDLVHQKVPVPMSILWQAPQYLLVGVGEVFTSIGQAEFFYNQSPDAMRSLCSAFALVTVSLGSYLSSFILTLVSYFTTRNGQLGWIPDNLNEGHLDRFFWLIAGLSSLNFLVFIYYAQQYKCKRASVA

SEQ ID NO: 512 - DNA, 1734 bp, Populus balsamifera subsp. trichocarpa
  misc_feature: Ceres Annot ID no. 1520085
  misc_feature: Encodes the peptide sequence at SEQ ID NO. 513
atgaacaaaaataatggactccacacaggagatggctcggtcgacattaatgggacggctgttcttaagcagaaaactggaaattggagagcatgctctttcatattgggaaatgaatgctgtgaacgcttggcctactatggaattgctactaatctggtctcctaccttactgggaagctacatgaaggaaatgtgtcagctgcaaaaaatgttaacatttgggcaggaacttgctacttcacaccactcattggagccactttggcagatgcttattggggaagatattggaccatttctgttttctccacaatttacttcattggaatgtgtacgttgactctctcagcaactattcctgtattaaagccagctgaatgtataggttctctatgccctccagcaactcctgctcagtatggggtattcttttttggcctctatctgattgcatttgggacaggtggcatcaaaccatgtgtttcatcctttggggcggatcagtttgatgacactgatcctaaggaaagggtaaagaaggggtccttcttcaattgtttctatttttcaatcaacattggttgtcttgtatcaagtagtttaatggtatacattcaagacaaagctgggtgggggctaggatttggaattcctgcattgttcatgggcatagctattgctatcttcttttcaggcacgcccctttatagatttcagaggccagtggggagcccaattactagaatgtgccaagttgtggttgcgtcattccataagaggaatttggaggttccccaagacattagtctcctatatgaaacccaagaaaaacactcaaccattgagggaacctggaaactagcgcacagcaatgaattgaaatgccttgataaagctgctataatttcagaggctgagataaaaggtggggacttcagtgatccatggaggctttgtactatgactcaggtggaggaattgaagattttgatccgcatgtttccgatctgggctacaggcattgtcttttctgctgcccatgcccaaatgagtacaatctttgtggaacaagggatgctgatggacaagacaattggttctttcaacatccctcctgcttctatgatcacaattgatgttattagtgttattttctgggttccaatctatgataggatcattgttccaattgcaaggaagttcactggcagagagaggggcttttcagagttgcagcgtatgggaattggcttgttcatttctatgctatcaatgacagctgctgctttgctagagattaagcgcttgcagcttgtaaaagagcttggattggttggtgatgctgttgcagttcctctcagtatcttgtggcaaattccccagtatatgttgatgggtacagcagagatctttacatccattggtcagcttgaatttttctatgaacagtctccagatgccatgcggagtctatgcagtgctttgtcactcctggctgcatctttgggtaattacctgagctcttttattctgagcatggtaacttacctcacaaccacgggtgggaagacaggatggataccagataacttaaataaggggcaccttgattatttattctggcttttggctgggctcagcttcttcaacttgctgatctacactatttgtgcaaagagatttataaagagaagaaggcctcctaaggtttttacaagaggggaggcctag

SEQ ID NO: 513 - protein, 577 aa, Populus balsamifera subsp. trichocarpa
  misc_feature (97)..(501): Pfam Name: PTR2 Pfam Description: POT family
  misc_feature: Ceres Annot ID no. 1520085
  misc_feature: Bit score of 1157.8 for HMM based on sequences of Figure 11
  misc_feature: Functional Homolog Of SEQ ID NO. 426
MNKNNGLHTGDGSVDINGTAVLKQKTGNWRACSFILGNECCERLAYYGIATNLVSYLTGKLHEGNVSAAKNVNIWAGTCYFTPLIGATLADAYWGRYWTISVFSTIYFIGMCTLTLSATIPVLKPAECIGSLCPPATPAQYGVFFFGLYLIAFGTGGIKPCVSSFGADQFDDTDPKERVKKGSFFNCFYFSINIGCLVSSSLMVYIQDKAGWGLGFGIPALFMGIAIAIFFSGTPLYRFQRPVGSPITRMCQVVVASFHKRNLEVPQDISLLYETQEKHSTIEGTWKLAHSNELKCLDKAAIISEAEIKGGDFSDPWRLCTMTQVEELKILIRMFPIWATGIVFSAAHAQMSTIFVEQGMLMDKTIGSFNIPPASMITIDVISVIFWVPIYDRIIVPIARKFTGRERGFSELQRMGIGLFISMLSMTAAALLEIKRLQLVKELGLVGDAVAVPLSILWQIPQYMLMGTAEIFTSIGQLEFFYEQSPDAMRSLCSALSLLAASLGNYLSSFILSMVTYLTTTGGKTGWIPDNLNKGHLDYLFWLLAGLSFFNLLIYTICAKRFIKRRRPPKVFTRGEA

SEQ ID NO: 514 - DNA, 1713 bp, Populus balsamifera subsp. trichocarpa
  misc_feature: Ceres Annot ID no. 1514979
  misc_feature: Encodes the peptide sequence at SEQ ID NO. 515
atggcagaggaggatgtttatacaaaagatggaactgtggattatctggggaatcctgctaacagaaaggagactggaacctggagggcctgcccttttattataggaaatgaattttgtgaacgattggcgtactatgggatgagctccaatctggttctttatttcaagcacagactgaaccagagcagtgctacagctactagaaataacttgaactggggtggaacatgctatctcactccattgatcggagcattcgttgctgatgcttatctaggaagatattggacgattgctagtttctcaaccatttatgttgcagggatgacgcttttgacaatgtcagcaactgtccatggcctcaggccagaatgttattcaaaagatcattgccatccaacaggtggtcaaactgctgtaactttcgtagcactttacctgatagcacttggcacaggaggtattaagccttgtgtctcatcctatggagcagatcagtttgatgatgctgacgaaactgagaagaaacacaagagttcattctttaactggttctacctctcgattaatgttggtgctcttattgccggttctgtgctggtttggatacaagataatgtgagttggggatggggttttggcattccagcaatagccatggcaattgctgttgtgagcttcttttcaggtaccaagttgttcaggtatcaaaagcctggaggcagccctcttacacgcatctgtcaggtgctggtggcatccttcagaaaacagaaagttgaagttcctgctgacaagtctctgttgcatgagactgcagatgccgaatccaacatcaaaggaagccgcaagctcgaccatactgaagaatttagtttccttgacaaggcagcagtagaaacagaaaaggacgacataaaagggacaggagacccatggaatctttgcacagtaacccaggtcgaggagctaaaggctatcattcggttgcttcctatatgggccactggtatcatcttttctgcagtgtacagccaaatggggaacttatttgtgctgcaaggtgaaacaatggataaatttgttggaaactccactttcgagataccatctgcatctttatccatctttgacacccttagtgtcattttttgggtccctgtgtatgaccgaattatcgtcccagttgcaagaaaattcactggacataaaaacggcttaactcaactgcagcggatgggcattggtctattcatatcaatatttgccatggtatctgcagcaatcttggaacttaaaagactgcaaatggtgagaaataacaactactacgaacttgattccgtgcccatttctatattttggcaagttccacagtatttcctgataggctgtgccgaagttttcacgttcatcggacaattggaattcttctacgaacaagcacctgatgcaatgaggagcatgtgttctgccctgtcactcaccaccgtcgcacttggcaattacttaagctctcttctggtaaccattgttacaaccatcagcactaagaatggaaaggctggatggattccggacaacttaaattacggtcacattgattacttcttctggctactaggaatgctcagtgtgctgaatttaggtgcctttctcttgatctcaaattggtacacttataaaaaggctataggaactcttcgttga

SEQ ID NO: 515 - protein, 570 aa, Populus balsamifera subsp. trichocarpa
  misc_feature (96)..(499): Pfam Name: PTR2 Pfam Description: POT family
  misc_feature: Ceres Annot ID no. 1514979
  misc_feature: Bit score of 1132.8 for HMM based on sequences of Figure 11
  misc_feature: Functional Homolog Of SEQ ID NO. 426
MAEEDVYTKDGTVDYLGNPANRKETGTWRACPFIIGNEFCERLAYYGMSSNLVLYFKHRLNQSSATATRNNLNWGGTCYLTPLIGAFVADAYLGRYWTIASFSTIYVAGMTLLTMSATVHGLRPECYSKDHCHPTGGQTAVTFVALYLIALGTGGIKPCVSSYGADQFDDADETEKKHKSSFFNWFYLSINVGALIAGSVLVWIQDNVSWGWGFGIPAIAMAIAVVSFFSGTKLFRYQKPGGSPLTRICQVLVASFRKQKVEVPADKSLLHETADAESNIKGSRKLDHTEEFSFLDKAAVETEKDDIKGTGDPWNLCTVTQVEELKAIIRLLPIWATGIIFSAVYSQMGNLFVLQGETMDKFVGNSTFEIPSASLSIFDTLSVIFWVPVYDRIIVPVARKFTGHKNGLTQLQRMGIGLFISIFAMVSAAILELKRLQMVRNNNYYELDSVPISIFWQVPQYFLIGCAEVFTFIGQLEFFYEQAPDAMRSMCSALSLTTVALGNYLSSLLVTIVTTISTKNGKAGWIPDNLNYGHIDYFFWLLGMLSVLNLGAFLLISNWYTYKKAIGTLR

SEQ ID NO: 516 - protein, 587 aa, Vitis vinifera
  misc_feature (113)..(521): Pfam Name: PTR2 Pfam Description: POT family
  misc_feature: Public GI ID no. 147858202
  misc_feature: Bit score of 1351.3 for HMM based on sequences of Figure 11
  misc_feature: Functional Homolog Of SEQ ID NO. 426
MASMACLNIFQKGRGKTRNEQEECTFDGSVDRHGHPAVRARTGNWVTAILILVNQGLATLAFFGVGVNLVLFLTRVLGQDNATAANNVSKWTGTVYIFSLLGAFLSDSYWGRYKTCAIFQVIFVIGLVLLSLSSYIFLLKPNGCGDKEFPCGSHSTFEISFFYLSIYLIALGNGGYQPNIATFGADQFDEDNPKESHSKVAFFSYFYLALNLGSLFSNTILGYFEDGGRWVLGFWASSASAILALILFLFGIPRYRHFKPSGNPLSRFCRVVVAATRKWKVEMPPEGEDLYEVDGDDCSGNCRRKMLHTQGFKFLDKAAVLTAKEREQEDKESRSPWRICTVTQVEEVKCILRLLPIWLCTILYSVVFTQMASLFVEQGAAMKTTLLGFHIPPASMSSFDIVSVAAFIFIYRRVLDPLVARLKGTKARGLTELQRMGIGLIIAIIAMVAAGIVEWFRLKYAKKDCRQCESESSLSIFWQIPQYVLIGASEVFMYVGQLEFFNDQAPDGLKSFGSALCMTSISLGNYVSSLLVTIVMKFSTRDQMPGWIPSNLNKGHLDRFYFLLAALTMADFGVYIICAKVVTSPSS

SEQ ID NO: 517 - protein, 574 aa, Oryza sativa subsp. indica
  misc_feature (122)..(507): Pfam Name: PTR2 Pfam Description: POT family
  misc_feature: Public GI ID no. 125545538
  misc_feature: Bit score of 1153.0 for HMM based on sequences of Figure 11
  misc_feature: Functional Homolog Of SEQ ID NO. 426
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 518 - protein, 591 aa, Oryza sativa subsp. japonica
  misc_feature (121)..(525): Pfam Name: PTR2 Pfam Description: POT family
  misc_feature: Public GI ID no. 115451771
  misc_feature: Bit score of 1131.5 for HMM based on sequences of Figure 11
  misc_feature: Functional Homolog Of SEQ ID NO. 426
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAHNSSMFIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 519 - protein, 574 aa, Oryza sativa subsp. japonica
  misc_feature (122)..(507): Pfam Name: PTR2 Pfam Description: POT family
  misc_feature: Public GI ID no. 125587732
  misc_feature: Bit score of 1153.1 for HMM based on sequences of Figure 11
  misc_feature: Functional Homolog Of SEQ ID NO. 426
MAEVTVVRAEPQEGSTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 520 - DNA, 1755 bp, Populus balsamifera subsp. trichocarpa
  misc_feature: Ceres Annot ID no. 1516968
  misc_feature: Encodes the peptide sequence at SEQ ID NO. 521
atggctaagattaacaagtatccagtccttgtcagtttcgtattatatttccaggatgaaagcaatggactctacacaggagatggctcagttgacattaatgggaaccctgtccttaagcagaaaactggaaactggaaagcatgccctttcatactgggtactgaatgttgtgaacgcctggcctactatgggattgctactaatctcgtcacttaccttaccaagaagctacatgaaggaaatgtgtcggctgcaagaaatgttaccacctggtcagggacatgctatcttacacccctcatcggagctgtattagcagatacttgttggggaagatattggactattgctgctttctcctcaatttacttcattggaatgtgtgcgttgactctctcagcatctattcctgcattaaagccagctgaatgcgtaggttctctgtgccctccagcaactccagctcagtatgcagtattcttttttggcctctatctgattgcgcttgggacgggtggcatcaaaccatgtgtttcatcctttggggcagatcaatttgatgacactgatcccaaggaacgggtaaagaagggatctttcttcaattggttctatttttcaatcaatattggtgctcttatatcaagtagttttctggtatatattcaagacaatgccggttggggactaggatttggaattcctgcactgttcatgggcatagctattgctagcttcttttcaggcacacccctttacagatttcaaagaccaggggggagccctattacaaggatgtgccaagttttggttgcatcattccataagtggaatctggaggttcctctagacagtagcctcctgtatgaaacacaagacaaacactctgccattgaaggaagccggaaactggtgcacagcgatgaactaaagtgccttgataaagctgctgtgctgtcagaggctgagatgaaaagtggggacttccccaacccttggaggctttgtactgtcacgcaggtggaggaattgaagattttgatccgcatgtttccaatctgggctacaggaattgtcttttccgctgtgtatgcccagatgtctactatgtttgtggaacaagggatgctgatggacacgacaattggttctttcacaattcctccagcatctctgtcatcctttgatgttattagtgttatttgctgggtgccaatctatgataggattgttgttcccattgcaaggaagttcacaggaaaagagaggggcttctcagatttgcagcgtatgggaattggcctgttcatttcagtgttatcaatgacagctgctgctttggtggagattaagcgcctacagcttgcgaaagagcttggcttggctggtgaagctgttgcagtgcctatcagtattttttggcagatcccccaatatatgttggtaggtgcttcagaagtttttacattcattggtcagattgaattcttctatgaagaatctccagatgcaatgcggagtttatgcagtgcgttgtcactcctgactacgtctttgggtaattacttgagctcttttattctgactatggtaacttacttcacaaccacgggtgggaagccaggatggatccccgataacttgaatgagggccacctcgattatttcttctggcttttagctggactcagcgttctcaacatgctggtctatgttttctgtgcgaggaaatataagcagaaggcctcctaa

SEQ ID NO: 521 - protein, 584 aa, Populus balsamifera subsp. trichocarpa
  misc_feature (114)..(518): Pfam Name: PTR2 Pfam Description: POT family
  misc_feature: Ceres Annot ID no. 1516968
  misc_feature: Bit score of 1250.0 for HMM based on sequences of Figure 11
  misc_feature: Functional Homolog Of SEQ ID NO. 426
MAKINKYPVLVSFVLYFQDESNGLYTGDGSVDINGNPVLKQKTGNWKACPFILGTECCERLAYYGIATNLVTYLTKKLHEGNVSAARNVTTWSGTCYLTPLIGAVLADTCWGRYWTIAAFSSIYFIGMCALTLSASIPALKPAECVGSLCPPATPAQYAVFFFGLYLIALGTGGIKPCVSSFGADQFDDTDPKERVKKGSFFNWFYFSINIGALISSSFLVYIQDNAGWGLGFGIPALFMGIAIASFFSGTPLYRFQRPGGSPITRMCQVLVASFHKWNLEVPLDSSLLYETQDKHSAIEGSRKLVHSDELKCLDKAAVLSEAEMKSGDFPNPWRLCTVTQVEELKILIRMFPIWATGIVFSAVYAQMSTMFVEQGMLMDTTIGSFTIPPASLSSFDVISVICWVPIYDRIVVPIARKFTGKERGFSDLQRMGIGLFISVLSMTAAALVEIKRLQLAKELGLAGEAVAVPISIFWQIPQYMLVGASEVFTFIGQIEFFYEESPDAMRSLCSALSLLTTSLGNYLSSFILTMVTYFTTTGGKPGWIPDNLNEGHLDYFFWLLAGLSVLNMLVYVFCARKYKQKAS

SEQ ID NO: 522 - DNA, 2468 bp, Zea mays
  misc_feature: Ceres Clone ID no. 350844
  misc_feature: Encodes the peptide sequence at SEQ ID NO. 523
atgatcggagctctataaatcgccccaaccccctccctcgttctgccaccattgccatatcctcgatcacaagagcagctactagctgcctctagctcgatcggttagtttgtcgtgttgcttacgtacgtcagcagaggccatcgtcgagtgtatccagtggtcgagaagagggaagaaatgtctgcgaacgacggcgccggcgacacgaagatgagggcgatcgtcgtcgtagaggaaggggagatgagcgcgccggcggcgacgccgaagcagggcaagtgctgcgagtacacgctggacggctccgtcgacatgaagggccggccggcggtcaaggggaaatcaggagggtggcttgccggtgctctaatcctcgtgaaccagggcctggcgacgctggctttcttcggcgtgaacgtgaacctggtgctgttcctgacccgggtgctggggcagagcaatggcgacgccgccaacaacgtcagcaagtggacgggcaccgtgtacatgttctccctcatcggcgccttcctcagcgactcctattggggacgctacaagacctgcgccatcttccaggccatctttgtcctcggcctcgcgctgctgtcggtgtcgtcgcacctctacctaatcaggccggacgggtgcggcatggagcacgcgccctgcggcccgcactccggcaaggagctggggatcttctacatcgcgctgtacatgatcgccttcggcaacggcgggtaccagcccaacatcgccaccctgggcgccgaccagttcgacgaggaggaccccgccgaggcgcactccaaggtctccttcttcagctacttctacctcgccctcaacctcggctcgctcttctccaacaccttcctcagctacctcgaggacaagggcagctgggcgctcggcttctgggcctccaccgccgccgccgccacagcgctcctgcttttcctcagcggcacgctccggtaccgctatttccagcccggagggaacccgatcggaaggattggccaggtcgccatcgccgcgtgcaggaactggaaggcgggcgtgtcgaccgaagtggtaagcctgtacgagggcgacgagaaggcggatgccggtggcaggaagcttctgcacacgcaagggttcagtttcttggaccgcgcggcgcacgcggacactgactccaagctcggcgcgcgcgatccctggaagctgtgctcggtgacgcaggtggaggaggtcaagagcatcctgaggctcctccccatctggctctgcaccatcctctactccgttgtcttcacccagatggcctcgctctttgtcgtgcagggcgccgcgatgcgccgcaccaccccgttctccggcttctccgtcccgccctccagcatgtcggccttcgacattctcacagtcgccgccacgattttcctgtaccgccgcactatctgcccgttcctagcgcggctcagcggccgcccggctggccccaccgagctgcagaggatgggcctcggcctggtcgtgggtgccctggccatgaccacggccgggacggtcgagcacttccggaaggccagggccaccgcagcgatgagcagcgacctgcatatcatgtggcaggtgccgcagtatgcgctgatcggcgtgtcggaggtgatgatgtacgtcgggcagctcgagttcttcaacggccagatgcccgacgggctcaaaagcttcggaagtgccttgtgtatgatgtccatgtcgctcggcaactacttcagtgacatcatcgtgagcgcggtgaccaggctcaccacgacgcgagggcggtccgggtggatcccggctgacctcaacgaggggcacctcgacaagttctacttcctgctcgccgtgctggccgtcgcggacttcgcggtgtacctcgtatgcgcgagccgctacgggagcggcaaagtggacgggaggagcagcgacgacgaggaggagggagcggccggtcaggtgacatccccggcttacgcatgaccatcaccggccgcccggccggcgggcatcgtacgtatgttgttcttgtcttcttgaggtggaggctggcaggctgcaaatctcgagggccattggttatttggttgacggagttcttccattgacgacgatagcacaagcatggggcgagcatggacatagtgatatgactaattaaagaataagcacttaagcaggactagctaaacactacatgctgcagcatcatgctcgcggtttttggccagtgtaacaacagacgacgattgttactgaccacgactgttctttgcgtggtctacagagttcgcttctgcaaaattcaataatgggcgagtgctgtatcatataaagtcgcaggttgcgccacgtagctacgatgtgactaacaaacaaatatgtattcaagttatgtattaaacggttaaccgtgtctttttaccgtt

SEQ ID NO: 523 - protein, 613 aa, Zea mays
  misc_feature (127)..(525): Pfam Name: PTR2 Pfam Description: POT family
  misc_feature: Ceres Clone ID no. 350844
  misc_feature: Bit score of 1244.1 for HMM based on sequences of Figure 11
  misc_feature: Functional Homolog Of SEQ ID NO. 426
MSANDGAGDTKMRAIVVVEEGEMSAPAATPKQGKCCEYTLDGSVDMKGRPAVKGKSGGWLAGALILVNQGLATLAFFGVNVNLVLFLTRVLGQSNGDAANNVSKWTGTVYMFSLIGAFLSDSYWGRYKTCAIFQAIFVLGLALLSVSSHLYLIRPDGCGMEHAPCGPHSGKELGIFYIALYMIAFGNGGYQPNIATLGADQFDEEDPAEAHSKVSFFSYFYLALNLGSLFSNTFLSYLEDKGSWALGFWASTAAAATALLLFLSGTLRYRYFQPGGNPIGRIGQVAIAACRNWKAGVSTEVVSLYEGDEKADAGGRKLLHTQGFSFLDRAAHADTDSKLGARDPWKLCSVTQVEEVKSILRLLPIWLCTILYSVVFTQMASLFVVQGAAMRRTTPFSGFSVPPSSMSAFDILTVAATIFLYRRTICPFLARLSGRPAGPTELQRMGLGLVVGALAMTTAGTVEHFRKARATAAMSSDLHIMWQVPQYALIGVSEVMMYVGQLEFFNGQMPDGLKSFGSALCMMSMSLGNYFSDIIVSAVTRLTTTRGRSGWIPADLNEGHLDKFYFLLAVLAVADFAVYLVCASRYGSGKVDGRSSDDEEEGAAGQVTSPAYA

SEQ ID NO: 524 - DNA, 1746 bp, Sorghum bicolor
  misc_feature: Ceres Annot ID no. 8658700
  misc_feature: Encodes the peptide sequence at SEQ ID NO. 525
atgggagaggtcgcggacatgtacacccaagacgggacggtggacaggaaggggaatcccgccctgaagaaggacaccggcaactggagggcatgcccctacatcctcgcgaacgagtgctgcgagaggctggcctactatggcatgagcaccaaccttgttcactacatgaagacccggcttggccaggtgaacagcgtcgcctccaacaacgtcaccaactggtcagggacgtgctacatcacgccactcatcggcgccttcttcgccgacgcgtacctggggaggttctggaccatcgccagcttcatggtcatctacattttcggactggcgctgctgacgatggcgtcgtcggtgaaggggctggtgcctacgtcgtgtgacaatgacggcgtgtgccacccgacggacgcgcagtcggcggtggtgttcgtggcgctgtacctgatcgcgctgggaacgggcgggatcaagccctgcgtgtcctccttcggcgccgaccagttcgacgagaacgacgagcgggagaagaagagcaagagctccttcttcaactggttctacttctccatcaacatcggcgcgctggtggcgtccacggtgctggtgtacgtgcagacgcacatcggctggggctggggcttcggcatccccgccgtggtcatggccatcgccgtcgtcagcttcttcgtgggcacgccgctgtacaggcaccagaagcccggtggcagcccgctgacgcgcatcgcgcaggtgctcgtcgcgtgcgcgcgcaagtggaacgtggccgtgcccgccgacaagtcgcgcctccacgagacgctggacaaggagtccggcatcgagggcagccgcaagctggagcacacggaccagctcgcgtgcctcgacagggctgccgtcgtgacggccgaggacagcgccgcgggggcggcgacggcgacgagcccgtggcgcctgtgcacggtgacgcaggtggaggagctcaagagcgtgatccggctgctccccatctgggcgagcgggatcgtgttcgcggcggtgtactcgcagatgagcaccatgttcatcctccagggcgacacgctggaccagcgcatggggtccaagttcaagatcccctcggcgacgctctccatggtggacaccatcagcgtcatcttctgggtgcccgtctacgaccgcgtcatcgtgcccgtcgtgcgctcctacaccggccgtccccgagggttcacgcagctgcagcggatgggcatcggcctcgtcgtctccatcttctccatggtggcggcgggcgtgctggacatcgtgcggctgaacgccgtggcgcggcacggcctgtacggcaaggacgaccacgtgcccatctccatcttctggcagataccgcagtacttcatcatcgggtgcgcggaggtgttcaccttcgtggggcagctggagttcttctacgaccaggcgcccgacgccatgaggagcatgtgctccgcgctgtcgctcaccaccgtcgcgctcggcaactacctcagcacggtgctggtgaccatcgtcacgcacatcaccaccaggaacggcaacatcgggtggatcccggagaacctcaaccggggccacctcgactacttcttctggctgctcgccgtgctcagcctcctcaacttcctcgtctacctcgtcatcgccacctggtacaagtacaagaagacggccgatgatatcccggacgccaaaggggagcactga

SEQ ID NO: 525 - protein, 581 aa, Sorghum bicolor
  misc_feature (97)..(504): Pfam Name: PTR2 Pfam Description: POT family
  misc_feature: Ceres Annot ID no. 8658700
  misc_feature: Bit score of 1207.1 for HMM based on sequences of Figure 11
  misc_feature: Functional Homolog Of SEQ ID NO. 426
MGEVADMYTQDGTVDRKGNPALKKDTGNWRACPYILANECCERLAYYGMSTNLVHYMKTRLGQVNSVASNNVTNWSGTCYITPLIGAFFADAYLGRFWTIASFMVIYIFGLALLTMASSVKGLVPTSCDNDGVCHPTDAQSAVVFVALYLIALGTGGIKPCVSSFGADQFDENDEREKKSKSSFFNWFYFSINIGALVASTVLVYVQTHIGWGWGFGIPAVVMAIAVVSFFVGTPLYRHQKPGGSPLTRIAQVLVACARKWNVAVPADKSRLHETLDKESGIEGSRKLEHTDQLACLDRAAVVTAEDSAAGAATATSPWRLCTVTQVEELKSVIRLLPIWASGIVFAAVYSQMSTMFILQGDTLDQRMGSKFKIPSATLSMVDTISVIFWVPVYDRVIVPVVRSYTGRPRGFTQLQRMGIGLVVSIFSMVAAGVLDIVRLNAVARHGLYGKDDHVPISIFWQIPQYFIIGCAEVFTFVGQLEFFYDQAPDAMRSMCSALSLTTVALGNYLSTVLVTIVTHITTRNGNIGWIPENLNRGHLDYFFWLLAVLSLLNFLVYLVIATWYKYKKTADDIPDAKGEH

SEQ ID NO: 526 - protein, 559 aa, Vitis vinifera
  misc_feature (96)..(488): Pfam Name: PTR2 Pfam Description: POT family
  misc_feature: Public GI ID no. 157346088
  misc_feature: Bit score of 1129.5 for HMM based on sequences of Figure 11
  misc_feature: Functional Homolog Of SEQ ID NO. 426
MAEEDIYTKDGTIDFRSNPAVKKETGTWKACPYILGNECCERLAYYGINTNLVNYLKFQLNQRNVVAINNVTNWSGTCYVTPLLGAFLADAYLGRYWTIAGFSIIYVFGMTLLTLSASAHGLKPLCDGQNVCYPTGLQTAVFFVGLYLIALGTGGIKPCVSSFGADQFDDSDETERKSKSSFFNWFYFSINIGALLASSVLVWVQTNVGWGWGFGIPAVAMGIAVMSFFSGTRLYRNQKPGGSPLTRICQVIVASLRKFQVEVPADKCLLYETADSESAVTGSRKLDHTKHLSFFDKAAVETHIDAIKGSVDSWRLCTVTQVEELKSIIRLLPIWATGIVFSAVYSQMGTLFVLQGNTMDLHITGSFQIPSASLSLFDTISVIFWVPIYDRLIVPFARKFTGHKSGFTQLQRIAIGLVISIFAMLVAGTLELLRLRMHIPMSIFWQVPQYFIIGCAEVFTFIGQLEFFYEQAPDAMRSLCSALSLTTAALGNYLSTLLVNVVTDVSTRGGKPGWIPDNLNYGHLHYFFWLLAALSVFNLGVYLQVARWYTYKRTAVDSL

SEQ ID NO: 527 - DNA, 2110 bp, Gossypium hirsutum
  misc_feature: Ceres Clone ID no. 1926916
  misc_feature: Encodes the peptide sequence at SEQ ID NO. 528
aacattccactccttcagcttgtgttaatatctaatcaaccaaattttaaggatcccagaacttctttttctttttcctttttgttaaaagattccaaaagttgttgacattaccaatctaacaagttgcaaaacaatcatgggatctatggatgaagagagatcgcttttggaagctgaacttaatcaggctgaaagcagtgggctttacactggggatggctccgttgacttcaatgggaatcctattttgaagcagaatactggaaattggagagcgtgccctttcattttgggtaatgaatgctgtgagagattggcttattatgggatagcaactaatcttgtaagttacctgaccaagaaactgcatgaagggaatgtatcagctgcaagaaatgtaactacttggcaaggaacttgctaccttacacctctcattggagccgtcttagcagatgcatattggggaagatattggacaattgctgctttctccactatttacttcttcggaatgtgtacattgactctctcagcatcaattcctgcactgaaacctgctgaatgtgtgggttctatttgtccctcagctactccagctcagtatgctgtatttttctttgggctttatctgattgcattagggacgggtggaatcaaaccgtgtgtttcatcctttggggccgatcagtttgatgatactgatcccaatgaaagggtgaagaaggggtcctttttcaactggttctatttttccatcaacattggtgctctgatctcaagcagtcttctggtgtggattcaggacaatgctggatggggtcttggatttggcattccagcattgtttatgggccttgcaattggaagttttttctcaggcacggcactctatagatttcaaagaccaggaggaagccctattacaagaatgttccaggttttggttgcagcatttcataaacggagcctcaaggtacctgaagacagtactctcctatatgaaactggtgacaagcactctgccatagaaggaagtcggaaactagagcacagtgaggagttgaagtgcctagataaagctgccatagtcactgatgttgaaaccaaaagtggggacttctcaaatccttggaggctttgcactgtaacacaagtggaggaattgaaaatcttgatccgcatgtttcccatatgggctactggaattgtgttctctgctgtatatgctcaaatgtcaactatgtttgtggaacaagggatgatgatggacacaaaaattggttctttcactattcctcctgcttctctctcaacttttgatgttattagtgttattttttgggtccccatctatgataggatcattgtcccaattgcaagaaagttcacacgtaaggagcgaggcttctcagagttgcagcgtatgggaattggtctttttatttcagtcctatgcatgtcagccgcagctgtggtggagaccaggagattgcaccttgctaaagagctagatttggtcgataagcaggtcgctgtacccattagtattctttggcaaatacctcaatatttcttgttgggtgccgcagaggtctgcacatttatcggacagcttgagttcttctatgatcagtcccctgatgccatgcggagtttatgtagtgcgctttcacttctgactacatctttaggcaattacctgagttcttttattctaactcttgtaacttacttcacaacaaagggtggccagattggttggatatcggacaaccttaacgagggtcatctcgactatttcttctggctcttggctggtctcagcttcttaaacatgttggtgtataccctttgtgcttcgaggtacaagcagaagaaggcttcctaaagttccttctcatatggagagaaattaagctgaaatgttgttatagataaaaactgtatgcatctcaatacagggacatccttccactttggaaaccaactatcttgtatcttattgggttatattcattttctagctgattctcgcatattgtacattaatactgcatggttttcaattatttgccatccttaaatgtcggattaaattgtttgc

SEQ ID NO: 528 - protein, 584 aa, Gossypium hirsutum
  misc_feature (113)..(517): Pfam Name: PTR2 Pfam Description: POT family
  misc_feature: Ceres Clone ID no. 1926916
  misc_feature: Bit score of 1251.4 for HMM based on sequences of Figure 11
  misc_feature: Functional Homolog Of SEQ ID NO. 426
MGSMDEERSLLEAELNQAESSGLYTGDGSVDFNGNPILKQNTGNWRACPFILGNECCERLAYYGIATNLVSYLTKKLHEGNVSAARNVTTWQGTCYLTPLIGAVLADAYWGRYWTIAAFSTIYFFGMCTLTLSASIPALKPAECVGSICPSATPAQYAVFFFGLYLIALGTGGIKPCVSSFGADQFDDTDPNERVKKGSFFNWFYFSINIGALISSSLLVWIQDNAGWGLGFGIPALFMGLAIGSFFSGTALYRFQRPGGSPITRMFQVLVAAFHKRSLKVPEDSTLLYETGDKHSAIEGSRKLEHSEELKCLDKAAIVTDVETKSGDFSNPWRLCTVTQVEELKILIRMFPIWATGIVFSAVYAQMSTMFVEQGMMMDTKIGSFTIPPASLSTFDVISVIFWVPIYDRIIVPIARKFTRKERGFSELQRMGIGLFISVLCMSAAAVVETRRLHLAKELDLVDKQVAVPISILWQIPQYFLLGAAEVCTFIGQLEFFYDQSPDAMRSLCSALSLLTTSLGNYLSSFILTLVTYFTTKGGQIGWISDNLNEGHLDYFFWLLAGLSFLNMLVYTLCASRYKQKKAS

SEQ ID NO: 529 - protein, 585 aa, Arabidopsis thaliana
  misc_feature (113)..(517): Pfam Name: PTR2 Pfam Description: POT family
  misc_feature: Public GI ID no. 15226861
  misc_feature: Bit score of 1180.1 for HMM based on sequences of Figure 11
  misc_feature: Functional Homolog Of SEQ ID NO. 426
MGSIEEEARPLIEEGLILQEVKLYAEDGSVDFNGNPPLKEKTGNWKACPFILGNECCERLAYYGIAGNLITYLTTKLHQGNVSAATNVTTWQGTCYLTPLIGAVLADAYWGRYWTIACFSGIYFIGMSALTLSASVPALKPAECIGDFCPSATPAQYAMFFGGLYLIALGTGGIKPCVSSFGADQFDDTDSRERVRKASFFNWFYFSINIGALVSSSLLVWIQENRGWGLGFGIPTVFMGLAIASFFFGTPLYRFQKPGGSPITRISQVVVASFRKSSVKVPEDATLLYETQDKNSAIAGSRKIEHTDDCQYLDKAAVISEEESKSGDYSNSWRLCTVTQVEELKILIRMFPIWASGIIFSAVYAQMSTMFVQQGRAMNCKIGSFQLPPAALGTFDTASVIIWVPLYDRFIVPLARKFTGVDKGFTEIQRMGIGLFVSVLCMAAAAIVEIIRLHMANDLGLVESGAPVPISVLWQIPQYFILGAAEVFYFIGQLEFFYDQSPDAMRSLCSALALLTNALGNYLSSLILTLVTYFTTRNGQEGWISDNLNSGHLDYFFWLLAGLSLVNMAVYFFSAARYKQKKASS

SEQ ID NO: 530 - DNA, 2216 bp, Triticum aestivum
  misc_feature: Ceres Clone ID no. 816960
  misc_feature: Encodes the peptide sequence at SEQ ID NO. 531
aaaatccaaaggtggctgtggctgtggctcacacacacacacacagagagagacaagagacagcgagtcacagaccgagggagggggagctcagaccaggccagcgggaatcgcgcgcgcgggccgggcgacgactgaggcggagatcccttccgaccggccgccgccgccgctcgtcgacaccgaccaacagaggaagcagttcctctgagttgctgcagcgcgtagtctgagagacaagcaagtacagcagccatgggggaggtcgcggcggagctgtacacccaggatggcaccatcgacatcaagggcaacccggccctcaagagcaacaccggcaactggcgagcatgcccctacatcctcgcgaacgagtgctgcgagcgccttgcctactacggcatgagcaccaacctggtcaacttcatgaaggaccggatgggcatggccaacgcggcggccgccaacaacgtcaccaactggggcggcacctgctacatcaccccgctcatcggcgccttcctcgccgacgcctacctcggccgcttctggaccatcgcctccttcatgatcatctacatcttcggcctcggcctgctcaccatggccacctccgtgcacggcctcgtgcccgcctgcgcctccaagggcgtgtgcgaccccacgccgggccagtcggcggccgtcttcatcgcgctctacctcatcgcgctcggcaccggcgggatcaagccctgcgtctcctccttcggggccgaccagttcgacgagcacgacgacgtggagcgcaagagcaagagctccttcttcaactggttctacttctccatcaacatcggcgcgctggtggcctcgtccgtgctggtgtacgtgcagacgcatgtggggtggagctggggcttcggcatccccgccgtcgtcatggccatcgccgtcggcagcttcttcgtcggcacgccgctgtaccgccaccagcgccccggcggcagcccgctcacccgcatcgcgcaggtgctcgtggccgccacgcgcaagctcggcgtccccgtcgacgggtcggcgctgtacgagaccgcggacagggagtccggcatcgaggggagccgcaagctggagcacacggggcagttcaggttcctcgacaaggcggcggtggagacgcaggcggacaagacggcggccaccgggccgtcgccgtggcggctgtgcacggtgacgcaggtggaggagctcaagagcgtggtgcggctgctgcccatctgggcgagcggcatcgtcttcgccacggtgtacggccagatgagcaccatgttcgtgctacagggcaacaccctggacgcctccatgggtcccaagttcaagatcccctccgcctccctctccatcttcgacaccctcagcgtcatcgcctgggtgcccgtctacgaccgcatcctcgtcccggcagtgcgctccgtcaccggccggccccgcggcttcacccagctccagcgcatgggcatcggcctcgtggtctccatgttcgccatgctcaccgccggcgtgctcgagctcgtccgcctccgcaccatcgcgcagcgcggcctctacggggagaaggacgtggtgcccatctccatcttctggcaggtgccgcagtacttcatcatcggcgccgccgaggtgttcaccttcgtgggccagctcgagttcttctacgaccaggcgcccgacgccatgaggagcatgtgctccgcgctctcgctcaccaccgtcgcgctcgggaactacctcagcacgctgctcgtcaccgtcgtggccaagctcaccaccaggggaggcaagcaggggtggatccccgacaacctcaacgtcggccacctcgactacttcttctggctgctcgccgcgctcagcctcctcaacttcgccgtctacctcctcatcgccagctggtacacctacaagaagaccgccggagatgacccggacgccaaagccaaaggaggagctgatgatgcacatgaccagtgagtgactctggctgcaacagttcgtgtctgaatgcgtgcgtgttttctttttcaagagacatgacagaatagattgttgaaagaagaagaagaagaaagcaaggatcgagacttcagagttcagataggtgaaattaagggaggacaatgaaatgcgtggtgtgatttgtgacttcaagattcaagagtgttgccttgttgatt

SEQ ID NO: 531 - protein, 585 aa, Triticum aestivum
  misc_feature (98)..(500): Pfam Name: PTR2 Pfam Description: POT family
  misc_feature: Ceres Clone ID no. 816960
  misc_feature: Bit score of 1243.0 for HMM based on sequences of Figure 11
  misc_feature: Functional Homolog Of SEQ ID NO. 426
MGEVAAELYTQDGTIDIKGNPALKSNTGNWRACPYILANECCERLAYYGMSTNLVNFMKDRMGMANAAAANNVTNWGGTCYITPLIGAFLADAYLGRFWTIASFMIIYIFGLGLLTMATSVHGLVPACASKGVCDPTPGQSAAVFIALYLIALGTGGIKPCVSSFGADQFDEHDDVERKSKSSFFNWFYFSINIGALVASSVLVYVQTHVGWSWGFGIPAVVMAIAVGSFFVGTPLYRHQRPGGSPLTRIAQVLVAATRKLGVPVDGSALYETADRESGIEGSRKLEHTGQFRFLDKAAVETQADKTAATGPSPWRLCTVTQVEELKSVVRLLPIWASGIVFATVYGQMSTMFVLQGNTLDASMGPKFKIPSASLSIFDTLSVIAWVPVYDRILVPAVRSVTGRPRGFTQLQRMGIGLVVSMFAMLTAGVLELVRLRTIAQRGLYGEKDVVPISIFWQVPQYFIIGAAEVFTFVGQLEFFYDQAPDAMRSMCSALSLTTVALGNYLSTLLVTVVAKLTTRGGKQGWIPDNLNVGHLDYFFWLLAALSLLNFAVYLLIASWYTYKKTAGDDPDAKAKGGADDAHDQ

SEQ ID NO: 532 - protein, 570 aa, Arabidopsis thaliana
  misc_feature (96)..(499): Pfam Name: PTR2 Pfam Description: POT family
  misc_feature: Public GI ID no. 15232435
  misc_feature: Bit score of 1171.6 for HMM based on sequences of Figure 11
  misc_feature: Functional Homolog Of SEQ ID NO. 426
MEEKDVYTQDGTVDIHKNPANKEKTGNWKACRFILGNECCERLAYYGMGTNLVNYLESRLNQGNATAANNVTNWSGTCYITPLIGAFIADAYLGRYWTIATFVFIYVSGMTLLTLSASVPGLKPGNCNADTCHPNSSQTAVFFVALYMIALGTGGIKPCVSSFGADQFDENDENEKIKKSSFFNWFYFSINVGALIAATVLVWIQMNVGWGWGFGVPTVAMVIAVCFFFFGSRFYRLQRPGGSPLTRIFQVIVAAFRKISVKVPEDKSLLFETADDESNIKGSRKLVHTDNLKFFDKAAVESQSDSIKDGEVNPWRLCSVTQVEELKSIITLLPVWATGIVFATVYSQMSTMFVLQGNTMDQHMGKNFEIPSASLSLFDTVSVLFWTPVYDQFIIPLARKFTRNERGFTQLQRMGIGLVVSIFAMITAGVLEVVRLDYVKTHNAYDQKQIHMSIFWQIPQYLLIGCAEVFTFIGQLEFFYDQAPDAMRSLCSALSLTTVALGNYLSTVLVTVVMKITKKNGKPGWIPDNLNRGHLDYFFYLLATLSFLNFLVYLWISKRYKYKKAVGRAH

SEQ ID NO: 533 - DNA, 1758 bp, Sorghum bicolor
  misc_feature: Ceres Annot ID no. 8643789
  misc_feature: Encodes the peptide sequence at SEQ ID NO. 534
atggcggccatggccagtggaggagatgagacgacgacgacgacgcttgacgggacgacggatcactccggcaagccggcggtgcggagcaagacggggacgtggcgcgcgtgccctttcatcctgggcaacgagtgctgcgagcgcctggcctactacggcatgagctccaacctcgtcaactacatgatcgaccgcctccaccaggggaacgccgccgccgccaacaacgtcagcaactggtccggcacctgctacgtcatgcccctcctcggcgccttcctggccgacgcctacctcggcaggtaccgcaccatcgccgccttcatggcgctctacatcctcggcctcacgctgctcaccatgagcgccgccgtcccgggcctcaggccgccgcccgacggagcaggcgccgtgaccgcgggccagagcgccgccttcttcgtggcgctctacctcatcgcggtgggcacgggaggcatcaagccctgcgtctcatccttcggcgccgaccagttcgacgacgccgacccgcgcgagcgccagagcaagagctccttcttcaactggttctacatgtccatcaacgtcggcgcactcctcgcctcctccgtgctcgtctgggtccagatgaacgtcggctggggatggggctttggcatccccgccgccgccatggccgtcgccgtcgccagcttcctgatggggagcaagctgtacaggcaccagaagccggggggcagcccgctcacgcggatgctgcaggtggtggtcgccgcctggaggaagggaaagcagcccgtgcccgcggacgcgtccctgctccacgaggcgtcctccgcctccgcgtccgccatccagggcagcaggaagctggagcacacggagcagttccggtggctggacagggcggcggtggtgacctccaccgatgaggacggcaagaacaaccccgacccctggcggctgtgcacggtgacgcaggtggaggagctcaagagtgtcatccgtcttctgccggtgtgggcgagcggcatcgtcatgtcggcggtgtacagccagatgagcaccatgttcgtgctgcagggcaacacgctggacccgcgcatgggctccggcgccggcgccttcaagatcccctccgcctcgctctccatcttcgacaccctcagcgtcatcgcctgggcgcccgcctacgaccgactcgtcgtccccgccgcgcgccgctggacggggcacccgcgcggcttcacgcagctccagcgcatgggcatcggcctcgccgtctccgtcctgtccatgctcgccgcgggggcgctggaggtggccaggctccgcgtcgccgcctcgcacggcatgctcgacgactccaccaactacctgcccatctccatcttctggcaggtgccgcagtacttcatcatcggagccgcagaggtgttcaccttcatcggccagatcgagttcttctacgaccaggcgccggacgccatgaggagcatgggcaccgcgctctcgctcacctcgtccgcgctcggcagctacctcagcgcgctgctggtgtccgtcgtcaccgccatcaccacgaggaacggcggcctcggctggatccccgacaacctcaaccggggccacctcgactacttcttctggctgctctccgtgctcagcgtcatcaacttcgtcgtctacctctggattgcaaagtggtacaggtacaagcaggcaaccacaagttatgaactcagcagtgtatag

SEQ ID NO: 534 - protein, 585 aa, Sorghum bicolor
  misc_feature (103)..(510): Pfam Name: PTR2 Pfam Description: POT family
  misc_feature: Ceres Annot ID no. 8643789
  misc_feature: Bit score of 1111.7 for HMM based on sequences of Figure 11
  misc_feature: Functional Homolog Of SEQ ID NO. 426
MAAMASGGDETTTTTLDGTTDHSGKPAVRSKTGTWRACPFILGNECCERLAYYGMSSNLVNYMIDRLHQGNAAAANNVSNWSGTCYVMPLLGAFLADAYLGRYRTIAAFMALYILGLTLLTMSAAVPGLRPPPDGAGAVTAGQSAAFFVALYLIAVGTGGIKPCVSSFGADQFDDADPRERQSKSSFFNWFYMSINVGALLASSVLVWVQMNVGWGWGFGIPAAAMAVAVASFLMGSKLYRHQKPGGSPLTRMLQVVVAAWRKGKQPVPADASLLHEASSASASAIQGSRKLEHTEQFRWLDRAAVVTSTDEDGKNNPDPWRLCTVTQVEELKSVIRLLPVWASGIVMSAVYSQMSTMFVLQGNTLDPRMGSGAGAFKIPSASLSIFDTLSVIAWAPAYDRLVVPAARRWTGHPRGFTQLQRMGIGLAVSVLSMLAAGALEVARLRVAASHGMLDDSTNYLPISIFWQVPQYFIIGAAEVFTFIGQIEFFYDQAPDAMRSMGTALSLTSSALGSYLSALLVSVVTAITTRNGGLGWIPDNLNRGHLDYFFWLLSVLSVINFVVYLWIAKWYRYKQATTSYELSSV

SEQ ID NO: 535 - DNA, 1743 bp, Sorghum bicolor
  misc_feature: Ceres Annot ID no. 8631367
  misc_feature: Encodes the peptide sequence at SEQ ID NO. 536
atggatcctaccactattgattcgaaatggacgtctcccatcactgaagatgggtccatggacagacgaggaaacccagctgtcaagacaaccaccggaggatggagatctgccatcctgctgttagctaactatggactcgcgacgtgcgccttcttcggcgtcggcgtgaacctcgtggtgttcctgcgccgggtgctccaccagggcaacgccgaggcggccaacaacatcagcaagtggacagggaccgtctacatcttctccctcatcggcgccttcctcagcgactcctactggggccgttacgtcacctgcgccatctttcagatcatctatgtgacgggcctggtgatcctgtcgcttgcgtcatggttcttgttggtgaagccctccggctgcggcggcgtcaaggtgcactgcgacgagccgtcggcgcccggcgtcgcgctgttctacctgtccacctacatgatcgcgttcggcaacggagggtaccagccttccatcgcgaccttcggatcggaccagttcgacgagacggaccccaaggaggggcgctccaaggtcgccttcttcagctacttctacctggcgctcaacgtggggtccctgttttccaacacggtgctggtgtactacgaggactcagggcggtgggtcatggggttctgggtctcggcggccgccgccgcgctggcgctcgtgctcttcttgctcggcacgcccaactaccggcacttcaagccgagcggcaacccgctgacccgcgtcgcgcaggtgttcgtcgccgcgttccgcaagtggcacgctgaggttccccgcggcgagctcctccacgaggtggaaggagaggaccctaagatctcgggcatccgcaagatccttcacagcgacgagctcaggttcctcgacaaagcggcgacgatcaccgagggggagaagatggagaacccgtggaggctctgcacggtgacgcaggtggaggaggtgaagtgcatcctgaagatgctgcccatctggctgtgcacgatcgtgtactcggtggtgttcacccagatggcgtcgctgttcgtggagcagggcgccaccatggacaccaacatcgggtcgttccacttccccgcagcgagcatgtcgctgttcgacgtcctcagcgtgctggcgttcatcgccatctaccggcgggtcctggtgcccgtcatggcgcggctgtcgggcaacccgcagggcctgacggagctgcagcgcatgggcgtcgggctcgtgatcggcatggcggcgatggtggtggcgggcgtggtggaggtggagcggctgaagcgcgtggcagccccggaccagccgagctccctgagcgtgctgtggcaggtgccgcagtacgcgctgatcggggcgtcggaggtgttcatgtacgtggggcagctggagttcttcaacgggcaggcgcccgacggcgtcaagagcttcggcagcgcgctgtgcatggcgtccatctcgctggggaactacgtgagcatcatgctggtgagcgtggtcacaagcctcaccgccggggagaagcgtccggggtggatccctgggaacctcaactccggccacctggacaggttctacttcctcctcgcagcgctctcgctcgtcgacctcgccgtctacatcgcctgtgccatgtggtacaagggcatcaagcttgacggcggcgacggcgatgacagtagaaaggtctctgcgcatgtctag

SEQ ID NO: 536 - protein, 580 aa, Sorghum bicolor
  misc_feature (103)..(499): Pfam Name: PTR2 Pfam Description: POT family
  misc_feature: Ceres Annot ID no. 8631367
  misc_feature: Bit score of 1335.6 for HMM based on sequences of Figure 11
  misc_feature: Functional Homolog Of SEQ ID NO. 426
MDPTTIDSKWTSPITEDGSMDRRGNPAVKTTTGGWRSAILLLANYGLATCAFFGVGVNLVVFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLFSNTVLVYYEDSGRWVMGFWVSAAAAALALVLFLLGTPNYRHFKPSGNPLTRVAQVFVAAFRKWHAEVPRGELLHEVEGEDPKISGIRKILHSDELRFLDKAATITEGEKMENPWRLCTVTQVEEVKCILKMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYIACAMWYKGIKLDGGDGDDSRKVSAHV

SEQ ID NO: 537 - protein, 612 aa, Vitis vinifera
  misc_feature (141)..(545): Pfam Name: PTR2 Pfam Description: POT family
  misc_feature: Public GI ID no. 157339093
  misc_feature: Bit score of 1272.6 for HMM based on sequences of Figure 11
  misc_feature: Functional Homolog Of SEQ ID NO. 426
MLLFSVRIYVHFLSVREKNHEDLFSKQLGSLHYVSCVGWFILYLQNENSDLHTGDGSVDIHGKPVLRSNTGNWRACPFILGTECCERLAYYGIATNLVTYLTSKLHEGNVSAARNVTTWQGTCYLTPLIGAVLADAYCGRYWTIAAFSTIYFIGMCTLTLSATVPAFKPADCVGSVCPPATTAQYAVFFFGLYLIALGTGGIKPCVSSFGADQFDDTDPKERVKKGSFFNWFYFSINIGALVSSSFLVWIQDNAGWGLGFGIPALFMGIAIASFFSGTPLYRFQKPGGSPITRMCQVLVASFRKWKLEVPKDSNLLYETPDKNSAIEGSRKLEHSNELKCLDKAAVISDAEIKSGDFSNPWNLCTVTQVEELKILIRMFPIWATGIVFSAVYAQMSTMFVEQGMVMDTNIGSFTIPPASLSTFDVISVIFWVPVYDRILVPIARKFTGKERGFSELQRMGIGLFLSVLCMSAAALVEIKRLQLATALDLVDEDVAVPLSILWQIPQYFLLGAAEVFTFIGQLEFFYDQSPDAMRSLCSALSLLTTSLGNYLSAFILTVVTTLTTEDGKTGWIPDNLNKGHLDYYFWLLAGLSFLNLLVYMICAKIYKRKKGS

SEQ ID NO: 538 - DNA, 1767 bp, Sorghum bicolor
  misc_feature: Ceres Annot ID no. 8633031
  misc_feature: Encodes the peptide sequence at SEQ ID NO. 539
atggccggcgccgagcgcgtggaggctccctccttggaggagcaagggctcctcgctctagaggaatccaaccaactagtatacactggagatggatcagttgacttttctggaaatcctgttatcaaggaaagaactggtagatggaaggcatgtccattcatattaggtaatgaatgctgtgaacgactggcctattatggcatcgccacgaaccttgttacttacttgacaaaaaagctacatgttggcaatgcctctgctgctagcaacgtgactacatggcagggaacttgctacttgactccgcttattggagcagtcctggctgatgcatactgggggaagtattggataattgcaacatcctccatagtgtacttcatcgggatggtaatactgactctttcagcatcagttcctatgctcatgcctccatcctgtgaaggatccttttgcgcaccagcaagcccttttcagtatactgtcttttttcttggtctttatctgattgcactgggtgctggtggaattaagccatgcgtctcgtcctttggagctgatcaatttgatgatacagatcctgatgagcgaatccagaagggttctttctttaattggttctatctttcaataaatattggtggcctcatatcaagcagctttctggtttgggtgcaagacaatgttggatggggactgggctttggcattccgacagtatccatggggctggcaatcataagcttcttctctggcacatcactttataggttccaaaaacctggaggtagtcctattacacgagtatgccaggtgattgttgcctcgttgcgcaagtggaatgtgcatgtcccagaggacagctctctcttgtatgagcaacctgatggggtatcaacaattgaggggagtcggcaattagagcacacagatgaactcagattttttgacaaggctgctacagttgccaaagttgacgtgaaaactgctgacttcaacaatccatggcggatatgcacagtcacgcaggtggaagaactaaagatactggtaaggatgttccctatatgggcaacaacaatcgtgttttctgttgcatatgctcagatgtcaacaatgtttgtggaacaaggcatggtgcttgacccatccttgggttcattcaagtttcctccagcgtcgttatctacttttgacaccctaaccatcatcatatgtgtcccgatgtacaattacatcatggttccaatagctaggagattcactggcaacgggaggggctttacagagttgcagaggatgggcattggcctggtaatttccatcatagctatgtcagtcgctgcaatccttgaaatcaagcggctagaagttgccagggaagcacacctggtagatcagaacatcccagtcccattgagcatattctggcaaatccctcagtatttcctgatcggtctagcggaggtgttcacattcatcggagcgctcgagttcttttataatcagtcaccggatgccatgaggagcgtctgcagcgcacttaatcttctcaccgtttcctttgggaactatctcaacacgttcattttgacaatggttgcatactttactacaaggggaggtaaccctggatggattcctgacaacttgaacgaagggcatcttgattacttcttctggctcattgctggcctcagttttctgaacctgattgtatatgtcatctgtgctagcaaatacaagagcaagaaggcagcttga

SEQ ID NO: 539 - protein, 588 aa, Sorghum bicolor
  misc_feature (117)..(521): Pfam Name: PTR2 Pfam Description: POT family
  misc_feature: Ceres Annot ID no. 8633031
  misc_feature: Bit score of 1182.5 for HMM based on sequences of Figure 11
  misc_feature: Functional Homolog Of SEQ ID NO. 426
MAGAERVEAPSLEEQGLLALEESNQLVYTGDGSVDFSGNPVIKERTGRWKACPFILGNECCERLAYYGIATNLVTYLTKKLHVGNASAASNVTTWQGTCYLTPLIGAVLADAYWGKYWIIATSSIVYFIGMVILTLSASVPMLMPPSCEGSFCAPASPFQYTVFFLGLYLIALGAGGIKPCVSSFGADQFDDTDPDERIQKGSFFNWFYLSINIGGLISSSFLVWVQDNVGWGLGFGIPTVSMGLAIISFFSGTSLYRFQKPGGSPITRVCQVIVASLRKWNVHVPEDSSLLYEQPDGVSTIEGSRQLEHTDELRFFDKAATVAKVDVKTADFNNPWRICTVTQVEELKILVRMFPIWATTIVFSVAYAQMSTMFVEQGMVLDPSLGSFKFPPASLSTFDTLTIIICVPMYNYIMVPIARRFTGNGRGFTELQRMGIGLVISIIAMSVAAILEIKRLEVAREAHLVDQNIPVPLSIFWQIPQYFLIGLAEVFTFIGALEFFYNQSPDAMRSVCSALNLLTVSFGNYLNTFILTMVAYFTTRGGNPGWIPDNLNEGHLDYFFWLIAGLSFLNLIVYVICASKYKSKKAA

SEQ ID NO: 540 - protein, 591 aa, Oryza sativa subsp. indica
  misc_feature (121)..(525): Pfam Name: PTR2 Pfam Description: POT family
  misc_feature: Public GI ID no. 125543029
  misc_feature: Bit score of 1142.8 for HMM based on sequences of Figure 11
  misc_feature: Functional Homolog Of SEQ ID NO. 426
MEEAAEDRRLQVREEGGDQEPLLLLPQDANLYTGDGSVDIKGRPALKHATGNWRACFFILGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAQNSSMFIEQGMVLDKRVGSFIVPPASLSTFDVISVIIWIPFYDRVLVPIARKFTGREKGFSELQRIGIGLALSILAMLSAALVELRRLEIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 541 - protein, 593 aa, Oryza sativa subsp. japonica
  misc_feature (122)..(526): Pfam Name: PTR2 Pfam Description: POT family
  misc_feature: Public GI ID no. 115454995
  misc_feature: Bit score of 1234.1 for HMM based on sequences of Figure 11
  misc_feature: Functional Homolog Of SEQ ID NO. 426
MAEVTVVRAEREEESTLEQGLLAIPEESNQLTYTGDGSVDFSGNPVVKERTGRWRACPFILGNECCERLAYYGISTNLVTYLTKKLHDGNASAASNVTAWQGTCYLTPLIGAILADAYWGRYWTIATFSTIYFIGMAVLTLSASVPTFMPPPCEGSFCPPANPLQYTVFFLGLYLIALGTGGIKPCVSSFGADQFDDTDPVERIQKGSFFNWFYFSINIGALISSSFLVWVQDNIGWGIGFGIPTIFMGLAIISFFSGTSLYRFQKPGGSPITRVCQVVVASFRKWNVHVPEDSSRLYELPDGASAIEGSRQLEHTDELRCLDKAATITDLDVKADSFTNPWRICTVTQVEELKILVRMFPVWATTIVFSAVYAQMSTMFVEQGMMLDTSVGPFKIPPASLSTFDVVSVIIWVPLYDSILVPIARRFTGNPRGFTELQRMGIGLVISIFSMAAAAVLEIKRLDIARAEHLVDQNVPVPLNICWQIPQYFLVGASEVFTFVGSLEFFYDQSPDAMRSLCSALQLVTTALGNYLSAFILTLVAYFTTRGGNPGWIPDNLNQGHLDYFFWLLAGLSFLNFVIYVICANKYKSKKAA

SEQ ID NO: 542 - DNA, 1758 bp, Medicago truncatula
  misc_feature: Ceres Annot ID no. 8755090
  misc_feature: Encodes the peptide sequence at SEQ ID NO. 543
atggaaccagcaggaccccccaacaatgtcaatcctgacaatattgaagtagttgaggcgacagaaggaaatcatgtcaatggagaagtggcagatggaaagagtaaaggaggatggacaactgcatacatcttgctagctaatcaagcactggcaacactagcattctttggagttggagtgaacttggttctgttcctaacgagagtccttcgtcaagacagtgccgaggctgctaataatgtcagcttgtggactggaactgtttacatattttcactcttgggagcattccttagtgattcttattggggaagatacttaacatgcgctatctttcagctcttctttgttctgggtttggggctgatgtctttgacatcatggctgtttttgatcaaaccattaggttgcggtaatgaacatagcgtttgcaatgaaccaacaccattgggaataggcctattctatttgtcaatatatttggttgcatttggatatggagggcatcaacctaccttagcaacatttggagctgatcaatttgatgataagagtattcaacaaaccaactccagagaggctttctttagttacttttactttgcactcaatgttggatcactattttccaacaccattttggtttattacgaagataccggtatgtggacattgggtttcggtgtctccttagcctctgctattatagccttgatttcattcttagcaggatctcgaaaatatcgatatgttaaggcgtatggcaatcctgtcataagagtaatccaggtctttgttgctgccactaggaagtggaatgttgaacccgccaaggaggaccaactttacgaggttgacggcaatgtatccgccatcaaaggaagcagaaagattcttcactcccaagatataagattcatggacaaggcggcaacacggacagtaaaagacgggaatgaatccgggaaccaatggcgactttgcactgtaactcaagttgaggaagccaaatgtgtgttgagaatgataccagtttggctgtgcactattatttactctgttgtattcacacaaatggcttctctttttgtcgaacaaggtgatgtaatgaacaacaaggtaggaaaatttcacttgccagcagcaaccatgtctgtgtttgatatatgcagtgtccttgtatgcactggactttatcgccaagttctagttcccttggccggaaaattaagcggtaatcctaaggggttaagcgaacttcaaagaatgggagttggcctagttattggaatgcttgcgatggttgcagctggtgtaacggagtttgaaaggcttaaacaagttcagcctggacagaaacaaagtaatttgagtatattctgtcaaattccacagtatgttcttgttggtgcttcagaagtttttatgtatgtgggtcagttggagttcttcaatggtcaagcacctgatggcataaaaagctttggaagttcactttgtatggcatcaatttctcttggaaactatgttagcagcatgatggtgaaattggtgatgatattcactgctagaggcgaggaacctggatggattccgaataacttaaatgttgggcacatggacaggtttttctacctcattgcagcgctaagtgcccttgaccttgtcatctatgtgttctgtgctcggtggtacaagggtgtcacgaacattgaaggtagtgacaatgtcggaagccaagaggacaatgtttga

SEQ ID NO: 543 - protein, 585 aa, Medicago truncatula
  misc_feature (107)..(505): Pfam Name: PTR2 Pfam Description: POT family
  misc_feature: Ceres Annot ID no. 8755090
  misc_feature: Bit score of 1170.2 for HMM based on sequences of Figure 11
  misc_feature: Functional Homolog Of SEQ ID NO. 426
MEPAGPPNNVNPDNIEVVEATEGNHVNGEVADGKSKGGWTTAYILLANQALATLAFFGVGVNLVLFLTRVLRQDSAEAANNVSLWTGTVYIFSLLGAFLSDSYWGRYLTCAIFQLFFVLGLGLMSLTSWLFLIKPLGCGNEHSVCNEPTPLGIGLFYLSIYLVAFGYGGHQPTLATFGADQFDDKSIQQTNSREAFFSYFYFALNVGSLFSNTILVYYEDTGMWTLGFGVSLASAIIALISFLAGSRKYRYVKAYGNPVIRVIQVFVAATRKWNVEPAKEDQLYEVDGNVSAIKGSRKILHSQDIRFMDKAATRTVKDGNESGNQWRLCTVTQVEEAKCVLRMIPVWLCTIIYSVVFTQMASLFVEQGDVMNNKVGKFHLPAATMSVFDICSVLVCTGLYRQVLVPLAGKLSGNPKGLSELQRMGVGLVIGMLAMVAAGVTEFERLKQVQPGQKQSNLSIFCQIPQYVLVGASEVFMYVGQLEFFNGQAPDGIKSFGSSLCMASISLGNYVSSMMVKLVMIFTARGEEPGWIPNNLNVGHMDRFFYLIAALSALDLVIYVFCARWYKGVTNIEGSDNVGSQEDNV

SEQ ID NO: 544 - DNA, 1794 bp, Glycine max
  misc_feature: Ceres Annot ID no. 8755097
  misc_feature: Encodes the peptide sequence at SEQ ID NO. 545
atggcctgcttagaagtcagcaaagaggtaaagttcaaaggtgacacggaagaactcactcttgatggaagtgttgattggcatggtcgccctgcaattagagccaaatctggcagatgggttgctggaaccatcgttctattgaaccaaggtctggcaaccttagcattctttggagtaggggtgaacctagtgctgttcctgacaagagtgatggggcaagataatgctgaagctgcaaacaatgtgagcaagtggactggcacagtttacatcttctctcttgtgggtgctttcctaagtgattcgtattggggaagatacaaaacttgtgccatctttcaggtcatctttgtaataggtctagtatccttgtctctttcatcatacctctccttgattaggcctaaaggttgtgggaatgaaacaattccatgtgggaaacattcaagcttggagatggggatgttctacctctcaatctatcttattgctttagggaatggagggtatcaaccaaatattgccacatttggagctgatcagtttgacgaggagcactcaaaggagggttactcaaaggttgccttctttagctacttctatctggctttgaaccttggttcactcttctcaaacacaattctaggctattttgaagatgaaggactgtgggctctagggttctgggtgtctgcaggctctgcttttgctgcccttgtcttatttcttcttgggaccccaagatatagacacttcaaacctagtggcaatcctctttcaaggttcagccaagtccttgttgctgcatcaaggaaatggagagctcaaatggcatcaaatggagaggatctatatgtcatggatgaaaatgaatctcccaccaatggcaacaggaagattctccacaccgaagggttcaagtttctggatagagcagcgattatatcttccagagatctagaagaccaaaagagtggcgtttataacccctggcgtctctgccctataactcaagttgaagaagtgaagtgcatactaagacttcttcctatttggctttgcacgataatatactcagtggttttcacacaaatggcttctctttttgtggagcaaggggctgccatgaaaactacaatttcccatttcagaataccacctgcaagcatgtctagctttgacatcctcagcgtagctgtcttcattttcttctaccgtcgagtgattgatccacttgtcggaagacttaaaaagaaaagttccaagggacttactgagcttcagagaatgggaatagggcttgttatagctgtaatggcaatggtttcagctggaatagttgaatgctacagacttaagtatgcagacccagtatgcccccactgcagtggcacaagctctttaaccatcttttggcaaattcctcagtacacacttattggagcttcagaggttttcatgtatgtaggccagttagagttcttcaatgctcagacgccagatggcttaaagagcttcggaagtgccctttgcatgacgtccatatctcttgggaactacgtaagtagcttacttgttagtatagttatgaagatctccactgaggatcacatgccagggtggatccctggaaacttaaacagaggtcacctagataggttttacttcctcttagctatcttgacatctatagatttggtcctttatattgcatgtgcaaagtggttcaagagtatacagctggaagggaaatatgaagagaatgatatgcctggtagctttaaagtctaa

SEQ ID NO: 545 - protein, 597 aa, Glycine max
  misc_feature (108)..(516): Pfam Name: PTR2 Pfam Description: POT family
  misc_feature: Ceres Annot ID no. 8755097
  misc_feature: Bit score of 1281.3 for HMM based on sequences of Figure 11
  misc_feature: Functional Homolog Of SEQ ID NO. 426
MACLEVSKEVKFKGDTEELTLDGSVDWHGRPAIRAKSGRWVAGTIVLLNQGLATLAFFGVGVNLVLFLTRVMGQDNAEAANNVSKWTGTVYIFSLVGAFLSDSYWGRYKTCAIFQVIFVIGLVSLSLSSYLSLIRPKGCGNETIPCGKHSSLEMGMFYLSIYLIALGNGGYQPNIATFGADQFDEEHSKEGYSKVAFFSYFYLALNLGSLFSNTILGYFEDEGLWALGFWVSAGSAFAALVLFLLGTPRYRHFKPSGNPLSRFSQVLVAASRKWRAQMASNGEDLYVMDENESPTNGNRKILHTEGFKFLDRAAIISSRDLEDQKSGVYNPWRLCPITQVEEVKCILRLLPIWLCTIIYSVVFTQMASLFVEQGAAMKTTISHFRIPPASMSSFDILSVAVFIFFYRRVIDPLVGRLKKKSSKGLTELQRMGIGLVIAVMAMVSAGIVECYRLKYADPVCPHCSGTSSLTIFWQIPQYTLIGASEVFMYVGQLEFFNAQTPDGLKSFGSALCMTSISLGNYVSSLLVSIVMKISTEDHMPGWIPGNLNRGHLDRFYFLLAILTSIDLVLYIACAKWFKSIQLEGKYEENDMPGSFKV

SEQ ID NO: 546 - DNA, 1797 bp, Glycine max
  misc_feature: Ceres Annot ID no. 8755098
  misc_feature: Encodes the peptide sequence at SEQ ID NO. 547
atgtcttgcttagagtctcatgtctacaaagaggtaattagaaagtttgaagaagagtcagaagaagtcactcttgatgggagtgttgatttccatggacgtcctgcaatcagagccaaatctggcagatgggtggctgcaattatcatactcttgaaccaagctctggcaacccttgcattctttgggatcggcgtgaacctagtgttgtttctgacaagggtggtaggacaaaacaatgctgatgcagccaacaatgtgagcaagtggaccggaactgtttacatcttctctcttgtgggtgctttcctcagtgattcttattggggaagatataaaacatgtgctgtctttcaggtcatctttgttataggtctaatgtccttatccctgtcatcatacctattcttgcttaagcctaaaggttgtgggaatgaaacagttagttgtgggaaacattcaaaattggagatggggatgttctacctctcaatctatcttgttgccttggggaatggaggttatcaaccaaatattgccacatttggggctgatcagtttgatgaggagcactcaaaggagggtcacaacaaggtggccttctttagctacttctacctagcttttaacattggccaactcttctcaaacaccattcttgtctattttgaggacgaaggaatgtgggctcttggtttctggctgtctgcaggatctgcctttgctgcattggtcttgtttcttatatgcaccccaaggtatagacacttcaagcccagtggcaaccctatctccaggttcagccaagtcctagtggctgcatcaaggaaatccaaacttcaaatgtcatcaaacggagaggacttattcaacatggatgcaaaggaggcatccaacgatgccaacagaaagattctccacactcacgggttcaagttcttggatagggcagcgttcatatcttcaagagatctaggggaccagaaagggctcggttacaacccatggcgtctctgtcctgtaagtcaagttgaagaagtgaagtgcatactgagacttcttccaatctggctctgcaccataatatactcagtagttttcacacaaatggcttcactttttgtggagcaaggtgctgccatgaaaaccaaggtttccaacttcagaataccaccagctagcatgtccagctttgatatcctcagtgtggctgttttcattttcttttaccgtcgagttcttgatccatttgtgggaaaacttaaaaagacagattctaagggacttacagagcttcagagaatgggagttggacttgttatagctgtactggcaatggtttcggctggattagttgaatgctataggctcaagtatgcaaaacaaggatgcctacactgcaatgactcgagcactttaagcatcttctggcaaatccctcagtatgcatttataggagcttctgaggtttttatgtacgtaggtcagttggagttcttcaacgctcagacaccagacggcttaaagagctttggaagtgctctttgcatgacatccatttcccttgggaactatgtgagtagtttacttgttagtgtggttatgaagatatccaccgaagatcacatgccggggtggatccctggacacctcaacaaaggccacttagataggttttacttcctcttagctgccttgacatcgatagacttgatcgcttatattgcatgtgcaaaatggtacaagtctatacagctagaggccaaaactggagagattgatgagacacaagtataa

SEQ ID NO: 547 - protein, 598 aa, Glycine max
  misc_feature (112)..(520): Pfam Name: PTR2 Pfam Description: POT family
  misc_feature: Ceres Annot ID no. 8755098
  misc_feature: Bit score of 1255.3 for HMM based on sequences of Figure 11
  misc_feature: Functional Homolog Of SEQ ID NO. 426
MSCLESHVYKEVIRKFEEESEEVTLDGSVDFHGRPAIRAKSGRWVAAIIILLNQALATLAFFGIGVNLVLFLTRVVGQNNADAANNVSKWTGTVYIFSLVGAFLSDSYWGRYKTCAVFQVIFVIGLMSLSLSSYLFLLKPKGCGNETVSCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLICTPRYRHFKPSGNPISRFSQVLVAASRKSKLQMSSNGEDLFNMDAKEASNDANRKILHTHGFKFLDRAAFISSRDLGDQKGLGYNPWRLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCLHCNDSSTLSIFWQIPQYAFIGASEVFMYVGQLEFFNAQTPDGLKSFGSALCMTSISLGNYVSSLLVSVVMKISTEDHMPGWIPGHLNKGHLDRFYFLLAALTSIDLIAYIACAKWYKSIQLEAKTGEIDETQV

SEQ ID NO: 548 - DNA, 1761 bp, Glycine max
  misc_feature: Ceres Annot ID no. 8755099
  misc_feature: Encodes the peptide sequence at SEQ ID NO. 549
atggaagaaaaggtaaataaggagcaccaggtttgcacatcggatggagctattgatagccagggtcatcctgcagttcgagagaaaacgggtgactgggttgctgcaattttgattttagtgaatcaagggcttgctactttggcattctttggaattggagtgaatttggtgttgtttttgacgagagtgatgggtcaagacaatgctgaagcagccaacagtgtgagcaagtggacagggacagtttacctcttctctcttcttggagccttccttagtgactcttactggggaaggtacatgacctgtgccatcttccaggtcatatttgttattggtttggtgtcattatcactatcgtcttacatattcctactgaagccaagtggttgtggaaataaagagttaccatgtggatcacactcatcataccaaacgattttattctatgtttccatatacctaatagctctaggaaatggaggataccagcctaacattgctacatttggggctgatcaatttgatgaaggagataccagggaacaacattcaaaaattgtatttttcagctatttttatttggctttgaacattgggtcactcttctccaacaccatattgaattattttgaggatgatggactatggactttggggttctgggcttcagctggctctgctgctctggcattggttttgtttctttgtggcacacgaaggtatagatactttaagcctaatggaaaccctcttcctagattttgccaagtttttgtggctgctacaagaaaatggaaggtcaaggtgttacaagatgataaactttacgaggttgatgaattctcaaccgatgaagggagaaaaatgctccatactgaaggatttagattcttagacaaagcagcatttatcacatcaaagaatttcaaacaaatggaagagagtaaatgcagtccatggtatctatccactgtgacacaagtagaagaagtgaaatgcattctaagactactcccaatttggctatgcaccatattatactctgtcgtttttgctcaaatggcatcactttttgtggagcaaggcgatgccatggacactagaatatcatctttccacattcctccagcaagcatgtccacctttgacattctaagtgtagcaattgtcatcttcatttataggcgagttctcgaccctcttgtggccagaacaatgaaatcaaaaggactcactgaacttcaaaggatgggaattggtctagtcctagcaattatggccatggtttcagcaggattggtggagcactttaggctaaagaatgcaatagaagactgcaatgaatgtaaagggtctagttcactttccatattttggcaagtgccacaatatgtgtttgtgggggcatcagaagttttcatgtatgtgggtcaattagagttcttcaatgcacaaacacctgatggattaaagagttttggtagtgcactttgcatgacttcaatatcacttggaaactacgttagtagcttgcttgttgcaattgtgatgaagatttctgccacagatgagatgccaggatggatcccaggaaacttgaacaaagggcatttggatatgttttacttcctcttagcagcactcaccgcagctgatcttgtaatatatgtactgatggctaggtggtataaatatgtcaaatttcaaggaaacaatgagaatgacaccaacaaagaagaccctgaagtagtgtag

SEQ ID NO: 549 - protein, 586 aa, Glycine max
  misc_feature (101)..(504): Pfam Name: PTR2 Pfam Description: POT family
  misc_feature: Ceres Annot ID no. 8755099
  misc_feature: Bit score of 1291.8 for HMM based on sequences of Figure 11
  misc_feature: Functional Homolog Of SEQ ID NO. 426
MEEKVNKEHQVCTSDGAIDSQGHPAVREKTGDWVAAILILVNQGLATLAFFGIGVNLVLFLTRVMGQDNAEAANSVSKWTGTVYLFSLLGAFLSDSYWGRYMTCAIFQVIFVIGLVSLSLSSYIFLLKPSGCGNKELPCGSHSSYQTILFYVSIYLIALGNGGYQPNIATFGADQFDEGDTREQHSKIVFFSYFYLALNIGSLFSNTILNYFEDDGLWTLGFWASAGSAALALVLFLCGTRRYRYFKPNGNPLPRFCQVFVAATRKWKVKVLQDDKLYEVDEFSTDEGRKMLHTEGFRFLDKAAFITSKNFKQMEESKCSPWYLSTVTQVEEVKCILRLLPIWLCTILYSVVFAQMASLFVEQGDAMDTRISSFHIPPASMSTFDILSVAIVIFIYRRVLDPLVARTMKSKGLTELQRMGIGLVLAIMAMVSAGLVEHFRLKNAIEDCNECKGSSSLSIFWQVPQYVFVGASEVFMYVGQLEFFNAQTPDGLKSFGSALCMTSISLGNYVSSLLVAIVMKISATDEMPGWIPGNLNKGHLDMFYFLLAALTAADLVIYVLMARWYKYVKFQGNNENDTNKEDPEVV

SEQ ID NO: 550 - protein, 584 aa, Artificial sequence
  misc_feature (1)..(584): Artificial sequence of unknown origin
  misc_feature (100)..(504): Pfam Name: PTR2 Pfam Description: POT family
  misc_feature: Bit score of 1304.3 for HMM based on sequences of Figure 11
  misc_feature: Functional Homolog Of SEQ ID NO. 426
MDQKVRQFEVCTQDGSVDRHGNPAIRANTGKWLTAILILVNQGLATLAFFGVGVNLVLFLTRVMGQDNAEAANNVSKWTGTVYIFSLLGAFLSDSYWGRYKTCAIFQASFVAGLVMLSLSTGALLLEPSGCGVEESPCKPHSTVKTVIFYLSVYLIALGYGGYQPNIATFGADQFDADDSVEGHSKIAFFSYFYLALNLGSLLSNTVLGYFEDQGAWPLGFWASAGSAFAGLVLFLTGTPKYRHFKPRESPWSRFCQVLVASTRKAKIDVNYEDMNLYDSETQRTGDKKILHTKGFRFLDRAAIVTPDDEAEKVESGSTYDPWRLCSVTQVEEVKCVLRLLPIWLCTILYSVVFTQMASLFVVQGAAMKTNIKDFRIPASSMSTFDILSVAFFIFAYRRFLDPLFARLNKREPNKGLTELQRMGIGLVIAITAMISAGIVEIYRLKHKETASNSSSLSIFWQVPQYMMIGASEVFMYVGQLEFFNSQAPTGLKSFASALCMASISLGNYVSSLLVSIVMKISTRDYLPGWIPGNLNKGHLDRFYFLLAGLTAADFLVYLVCAKWYKYIKSEASFSESMDEEEEV

SEQ ID NO: 551 - protein, 596 aa, Glycine max
  misc_feature (110)..(518): Pfam Name: PTR2 Pfam Description: POT family
  misc_feature: Bit score of 1258.7 for HMM based on sequences of Figure 11
  misc_feature: Functional Homolog Of SEQ ID NO. 426
MSYLESQVYKERKFEEESEEVTLDGSVDFHGRPAIRAKSGRWVAAIIILLNQALATLAFFGIGVNLVLFLTRVVGQNNADAANNVSKWTGTVYIFSLVGAFLSDSYWGRYKTCAVFQVIFVIGLMSLSLSSYLFLLKPKGCGNESVNCGKHSKLEMGMFYLSIYLVALGNGGYQPNIATFGADQFDEEHSKEGHNKVAFFSYFYLAFNIGQLFSNTILVYFEDEGMWALGFWLSAGSAFAALVLFLVCTPRYRHFKPSGNPLSRFSQVLVAASRKSKVQMSSNGEDLFNMDAKEASNNANRKILHTHGFKFLDRAAFISSRDLGDQKGLGYNPWHLCPVSQVEEVKCILRLLPIWLCTIIYSVVFTQMASLFVEQGAAMKTKVSNFRIPPASMSSFDILSVAVFIFFYRRVLDPFVGKLKKTDSKGLTELQRMGVGLVIAVLAMVSAGLVECYRLKYAKQGCIHCNDSSTLSIFWQIPQYAFIGASEVFMYVGQLEFFNAQTPDGLKSFGSALCMTSISLGNYVSSLLVSVVMKISTEDHMPGWIPGNLNKGHLDRFYFLLAALTSIDLIAYIACAKWYKSIQLEANTGEIDEPEV

SEQ ID NO: 552 - protein, 526 aa, Arabidopsis thaliana
  misc_feature (37)..(446): Pfam Name: PTR2 Pfam Description: POT family
  misc_feature: Bit score of 1087.2 for HMM based on sequences of Figure 11
  misc_feature: Functional Homolog Of SEQ ID NO. 426
MGQDNAEAANNVSKWTGTVYIFSLLGAFLSDSYWGRYKTCAIFQASFVAGLMMLSLSTGALLLEPSGCGVEDSPCKPHSTFKTVLFYLSVYLIALGYGGYQPNIATFGADQFDAEDSVEGHSKIAFFSYFYLALNLGSLFSNTVLGYFEDQGEWPLGFWASAGSAFAGLVLFLIGTPKYRHFTPRESPWSRFCQVLVAATRKAKIDVHHEELNLYDSETQYTGDKKILHTKGFRFLDRAAIVTPDDEAEKVESGSKYDPWRLCSVTQVEEVKCVLRLLPIWLCTILYSVVFTQMASLFVVQGAAMKTNIKNFRIPASSMSSFDILSVAFFIFAYRRFLDPLFARLNKTERNKGLTELQRMGIGLVIAIMAMISAGIVEIHRLKNKEPESATSISSSSTLSIFWQVPQYMLIGASEVFMYVGQLEFFNSQAPTGLKSFASALCMASISLGNYVSSLLVSIVMKISTTDDVHGWIPENLNKGHLERFYFLLAGLTAADFVVYLICAKWYKYIKSEASFSESVTEEEEV

SEQ ID NO: 553 - DNA, 857 bp, Zea mays
  misc_feature: Ceres Clone ID no. 1384304
  misc_feature: Encodes the peptide sequence at SEQ ID NO. 554
ttactgcttcaattcgatcgttgctagaaagttgaaaccacgacatcggaggcgtgaaaaagttttaagtcacaccgaatcaatcaagtgggagggacacgttcttcaacctattaatcaaaccccactcttctcggtcacgaaagtcttggaagctttgcctgatttcgagcgacgatggacagatcggcgtcggtgggtatcaaggacggcggatttggtggcaaccacttgtattctccatcattttcttcttcatcttccatgagacatgtcaattacagttgtggatcttgtgggtacgagctgaacttgagctccaccaatcgaattacatcatcaattggatcgaagtatgggaaatccatgaagactggaatcatatccttcttcaacattgacgaggggagattcagccaggttgatgagttccaatgcatgcctcacttctccagatactcttggggtttgttcagacgcaagactaagcttctctgtcgccaatgtaataactacataggcaatgcttcttatgacaaggcccctcctgagtacgcactcgtaacacaaaactcatcgcccaggaagggtgtcactgacactgttaccaagtatgatatcagaattcgtgcgcttcaaccttcttccggtgttgcttctctgtgactgagtgtgtttcttctacaactgtatattgtagaaaattcttcaaagtatcagtactgttttcataaggtgggttcggctttttctttctttctcaaattgtacagtaatttaacaatttgccttttttttttttttttgtttctgagaatattgaggttaaatatgaatttcacttgctcatgttcatc

SEQ ID NO: 554 - protein, 162 aa, Zea mays
  misc_feature: Ceres Clone ID no. 1384304
  misc_feature: Bit score of 368.1 for HMM based on sequences of Figure 1
MDRSASVGIKDGGFGGNHLYSPSFSSSSSMRHVNYSCGSCGYELNLSSTNRITSSIGSKYGKSMKTGIISFFNIDEGRFSQVDEFQCMPHFSRYSWGLFRRKTKLLCRQCNNYIGNASYDKAPPEYALVTQNSSPRKGVTDTVTKYDIRIRALQPSSGVASL

SEQ ID NO: 555 - DNA, 495 bp, Arabidopsis thaliana
  misc_feature: Ceres Annot ID no. 564098
  misc_feature: Encodes the peptide sequence at SEQ ID NO. 556
atggagagatcagcgtcggtgggtgttaacgacggccgttttggtggcaaccaattctattcgccatctttctcttcttcttcttcttcttcttccatgagacatgttaattacagttgtggatcttgtgggtatgaactaaacctgagctccacgaatcgaatcacatcgacaatcggatcaaagtacggtaaatccatgaagagtgggatcatatctttcttcaacatcgacgagggaagattcagtcaggtcgatgagttccaatgcatgcctcacttctctagatactcttggggtttgtttcgacacagaacgaagcttctatgtcgcaaatgtaataattatatcggcaatgcttctcaggagaaggctcctgagtatgcacttgttacacaaaactcggatccgacatcgcctaggattggtagtgttacgaagtacgatatcagaatccgctcgcttcaaccttcttctgcggtcgctttgctgtga

SEQ ID NO: 556 - protein, 164 aa, Arabidopsis thaliana
  misc_feature: Ceres Annot ID no. 564098
  misc_feature: Bit score of 378.1 for HMM based on sequences of Figure 1
  misc_feature: Functional Homolog Of SEQ ID NO. 554
MERSASVGVNDGRFGGNQFYSPSFSSSSSSSSMRHVNYSCGSCGYELNLSSTNRITSTIGSKYGKSMKSGIISFFNIDEGRFSQVDEFQCMPHFSRYSWGLFRHRTKLLCRKCNNYIGNASQEKAPEYALVTQNSDPTSPRIGSVTKYDIRIRSLQPSSAVALL

SEQ ID NO: 557 - DNA, 495 bp, Populus balsamifera subsp. trichocarpa
  misc_feature: Ceres Annot ID no. 1443290
  misc_feature: Encodes the peptide sequence at SEQ ID NO. 558
atggaaaaatctaaggttggcaagggagcttacctcaacgggaatccccatcattccttctcttcttcctctgcttctcaaagacatgtcagctacagctgcggtatttgcgggtatgaattgaacttgagctcctccaatcggaacacctcatctattggctctaaatatgggaaatccataaagagagggatcatctcattcttcttcatcgatgagagcagatttacccaggttgatgaattccaatgcattcccttcttttcaagaaactcctggggtttgttccaccggagaacagcacttctttgccgcaagtgtggtaataatattggaattgcttatgatgataaagcctcagcttatccacttgtagcagacggatctgactcttcctcagtcagtgaagtttccaaacatcgaaaatatgatgttaaaatccgtgccttgcagccttcttctgttgaccagtttagcactccaattcacacctga

SEQ ID NO: 558 - protein, 164 aa, Populus balsamifera subsp. trichocarpa
  misc_feature: Ceres Annot ID no. 1443290
  misc_feature: Bit score of 417.4 for HMM based on sequences of Figure 1
  misc_feature: Functional Homolog Of SEQ ID NO. 554
MEKSKVGKGAYLNGNPHHSFSSSSASQRHVSYSCGICGYELNLSSSNRNTSSIGSKYGKSIKRGIISFFFIDESRFTQVDEFQCIPFFSRNSWGLFHRRTALLCRKCGNNIGIAYDDKASAYPLVADGSDSSSVSEVSKHRKYDVKIRALQPSSVDQFSTPIHT

SEQ ID NO: 559 - DNA, 936 bp, Glycine max
  misc_feature: Ceres Clone ID no. 1042157
  misc_feature: Encodes the peptide sequence at SEQ ID NO. 560
attatcttcttcttctctacctttcgatcctttcactttggcgtgaccgaaccattccactccctcgcaaaacggtgtcgtgccgatcgcgttcgttcggttaaactcgcgcgttcagaatcctccggaacaacgctcttcgcccaattccctataattcactcctctctctctctcgctttctctggtaacctcctcgcgacggtggctcttccgcattccgccgccgccactgccatcgccgttgccgccgccggaaaacactaatcaatagatggatgattctgcgttcaaacgaggcggtcactttaatcgaacttactcgtgctcttctcagagagatgtctgttacagctgtggcacttgtggttatgagctgaacctatcctcctcaaaccggaacactgcatccattggatctaaatacgggaagtccataaagcgaggtattatatcattcttcagcattgatcttagcagatttactcaggttgatgaaattcagtgtgtgccccattttgataagcactcatggggtttgtttcgccgaagaaccaagcttctttgtcgcaagtgtggcaaccatattggaaatgcatacaatggttacacttcgtcctttcctcttgtgtcagacggagcagaatcatctcctagttccaaagtggtcagtcatacaaaatatgacattcgcatttgtgccttacaaccttcatcttctgaagaatctggaatccccgtgtttgcttgaactacctggtaaaaatagtaattcctacacagccaaatccggtgacagggtggttagaagttcattaatatatgcagatggtttggcttgttttttgtgcttttcctaatgaaaatgtgactaatagtcgtgtgaaagagttgtaagaattaaattaaaaattattacaggtgtgggattttatg

SEQ ID NO: 560 - protein, 158 aa, Glycine max
  misc_feature: Ceres Clone ID no. 1042157
  misc_feature: Bit score of 404.0 for HMM based on sequences of Figure 1
  misc_feature: Functional Homolog Of SEQ ID NO. 554
MDDSAFKRGGHFNRTYSCSSQRDVCYSCGTCGYELNLSSSNRNTASIGSKYGKSIKRGIISFFSIDLSRFTQVDEIQCVPHFDKHSWGLFRRRTKLLCRKCGNHIGNAYNGYTSSFPLVSDGAESSPSSKVVSHTKYDIRICALQPSSSEESGIPVFA

SEQ ID NO: 561 - DNA, 994 bp, Gossypium hirsutum
  misc_feature: Ceres Clone ID no. 1919714
  misc_feature: Encodes the peptide sequence at SEQ ID NO. 562
gagcgcgttccctcttctctagaaactgctgctgtttttttttcatccttttaactcagtccctgaaaattgagccgttaacgtcaacccgattcaggcggaaccgtttcctcactcaaaatcctcgcacaaactcagcagttaattaaacacttcataaagttgagtcgctttattagcacagttgccgttatagtgataatcaaaggtgttgattctgtaggaagaaggaaaaaagtaatggagaaatctgtttttgttaaagatgtacaacaactcaatggaaatctccaccattctttttcctctgtttctcaaagagatgtaacttacagctgtggttcttgtgggtatgagctaaacctaagttcctctagtagaaacaccgcaacaatcggctctaaatatggaaaattgattaagcgagggatgatatcattcttcaatatagacgagaccagatttacgcaggtcgatgaattccaatgcagaccctacttttcgaagcactcatggggtttattccgccatagaaccaaattactttgtcgcaagtgtgggaaccacattggcgatgcttatgatgataaatcttctggctaccctcatgtcttagatggttctgattcatcctccggcactgaaccttctaaccatagaaaatatgatgttagaatccgtgccctacagccttcgactgctgaaggactcggctctccactttttgcgtgatttcctgcagtgcatcattgatggtcttcggtttgaattatcaacgactgactgagcgttttcgtatgggattattgctgtctattagttggtttgagtcttccattttatgctgtctttgctgtgtttctgttaagtgtatatatgaaaggtaagtaatgtggagctttaaaatgaggttgagcacagtaatgtcattacccaaatttaagtgtaatatctgtttgagttgaattaaatcaagtatttttcttttggcctt

SEQ ID NO: 562 - protein, 163 aa, Gossypium hirsutum
  misc_feature: Ceres Clone ID no. 1919714
  misc_feature: Bit score of 433.3 for HMM based on sequences of Figure 1
  misc_feature: Functional Homolog Of SEQ ID NO. 554
MEKSVFVKDVQQLNGNLHHSFSSVSQRDVTYSCGSCGYELNLSSSSRNTATIGSKYGKLIKRGMISFFNIDETRFTQVDEFQCRPYFSKHSWGLFRHRTKLLCRKCGNHIGDAYDDKSSGYPHVLDGSDSSSGTEPSNHRKYDVRIRALQPSTAEGLGSPLFA

SEQ ID NO: 563 - protein, 164 aa, Vitis vinifera
  misc_feature: Public GI ID no. 157336039
  misc_feature: Bit score of 402.2 for HMM based on sequences of Figure 1
  misc_feature: Functional Homolog Of SEQ ID NO. 554
MENSMVLAHETQPHRDFSASSLRDVSYSCGSCGYELKLCSSNRNTKNIGSKYGKNIKRGVISFLQVDESRFTLVDEFKCIPYFISRHSWGLFCHRTKLLCRKCSNHVGNAYVRKSPYPLVLDESDSAPAPATATTDISTCRKYDIRLRALQPSSSEPSAIPLLT

SEQ ID NO: 564 - DNA, 459 bp, Solanum lycopersicum
  misc_feature: Ceres Annot ID no. 8454153
  misc_feature: Encodes the peptide sequence at SEQ ID NO. 565
atggacatcagtcatgacttagcaaaagttgattcgatgccaaacaaaaactcatctccctgctgtggcagttgtgggtatgagttaaatcttaattcatcaagtcgcaatactgcttccattgggtccaagtatgggaagtccattaagaaagggatgatctccttcttgtccattgatgagagcagatttacccaggttgatgaattcaagtgtgtaccgttctttttctccaaacgttcttggggcttgttccagcggcgaacaaaacttcagtgcagaaaatgtggtaacgatattggaattgcttatgatgatagtgcttcttcttacccacttgtagccgatgcatcagatacagcctccggtagtgaaataaccactcataggaaatacaatatcaaaatccgctcgttgcaaccgtcttcctcagcatcgggtactcctctccctgagtga

SEQ ID NO: 565 - protein, 152 aa, Solanum lycopersicum
  misc_feature: Ceres Annot ID no. 8454153
  misc_feature: Bit score of 376.0 for HMM based on sequences of Figure 1
  misc_feature: Functional Homolog Of SEQ ID NO. 554
MDISHDLAKVDSMPNKNSSPCCGSCGYELNLNSSSRNTASIGSKYGKSIKKGMISFLSIDESRFTQVDEFKCVPFFFSKRSWGLFQRRTKLQCRKCGNDIGIAYDDSASSYPLVADASDTASGSEITTHRKYNIKIRSLQPSSSASGTPLPE

SEQ ID NO: 566 - DNA, 1007 bp, Oryza sativa
  misc_feature: Ceres Annot ID no. 1722302
  misc_feature: Encodes the peptide sequence at SEQ ID NO. 567
agagccagccgagccagcgcggcgcggtcgcctttgccctgccctgcactgaccgttggagagccaagcaacccaacccaagcgctcttctcttctcctcctcttcctcccaaatcgatcgggatccgatgcgcacggaggaggaaggagcatggtgaggacgcccgagaggagctactcctgctcctccgccaaggaagtcgcctacagctgtggttactgtggctatgcattgaacctgagctcctcaacacggaacacagcgaacattggatccaagtatggtaagcagatcaggaaaggtgtaatctcattctttgcgatcgacgagagtcggttcacacaaactgatgaggtgagctgcatgccatacttccattcaaggcgctcctggggtttgttcagaaagaggacaaggttgatctgccgcaaatgtggtggccgtatcggtaatgcttatgaggatgaggattccacattgtatgatggttcagatgatttgcacatgagctccgagggctacagcatgtcgagtggaaagaaatatgttatcaagattaatgcactgcagccttcaaccgatgactctggtgttcccttcaccctgtgatgctgttctgaacttctgcagtatgcacttttcgattcttgccttgcgctatactggactgtcaatcaagtaactgcagaaccaagagattacgtgctagtgtgtaactgtatattttgataggaatgctgaattttgcctacctgtatttataaaatggaagagtttgttgtctatttacatatacattcagagttcagtgggtgtgcaactgtgcatcatggacctggatttggcaatccatatttgggcaaatgtttagttagaaatcaggtttctgatgatgttcagtggtgtgtacttgtgtcttgtactgaaatattgtagtgtcttttgattttttgtgtatctaaagaatgatgtaaatcttcagctattctaaacggcagtttttttt

SEQ ID NO: 567 - protein, 152 aa, Oryza sativa
  misc_feature: Ceres Annot ID no. 1722302
  misc_feature: Bit score of 374.0 for HMM based on sequences of Figure 1
  misc_feature: Functional Homolog Of SEQ ID NO. 554
MVRTPERSYSCSSAKEVAYSCGYCGYALNLSSSTRNTANIGSKYGKQIRKGVISFFAIDESRFTQTDEVSCMPYFHSRRSWGLFRKRTRLICRKCGGRIGNAYEDEDSTLYDGSDDLHMSSEGYSMSSGKKYVIKINALQPSTDDSGVPFTL

SEQ ID NO: 568 - DNA, 450 bp, Sorghum bicolor
  misc_feature: Ceres Annot ID no. 8733140
  misc_feature: Encodes the peptide sequence at SEQ ID NO. 569
atggcgagggccctcgaccgctacacctccggcaaggatgtcgcctacagttgtggatactgtggctatgcattaaacttgagctcctccgcacggaacacagcgaacattggatccaagtatggcaagcacatcaggaaaggcgttgtctcattctttgcaatcgatgagagccgttttacacaaactgatgaggtgagctgcaccccgtacttccattcaagccattcatggggattcttcagaaatagaacacggttgctctgccggaagtgcagtggtcatattggtaatgcttatgaagatgaggatcccaccttgtgcgatgggtcagatgacctggacatgagctccaagggcagcagcacatcccctcggaagaaatatgttattaagatcaatgcactgcagccctcatcagatgactctggagctctcttctccccgtga

SEQ ID NO: 569 - protein, 149 aa, Sorghum bicolor
  misc_feature: Ceres Annot ID no. 8733140
  misc_feature: Bit score of 356.4 for HMM based on sequences of Figure 1
  misc_feature: Functional Homolog Of SEQ ID NO. 554
MARALDRYTSGKDVAYSCGYCGYALNLSSSARNTANIGSKYGKHIRKGVVSFFAIDESRFTQTDEVSCTPYFHSSHSWGFFRNRTRLLCRKCSGHIGNAYEDEDPTLCDGSDDLDMSSKGSSTSPRKKYVIKINALQPSSDDSGALFSP

SEQ ID NO: 570 - DNA, 495 bp, Populus balsamifera subsp. trichocarpa
  misc_feature: Ceres Annot ID no. 1452096
  misc_feature: Encodes the peptide sequence at SEQ ID NO. 571
atggaaaaatctacggctttcagggaagcttacctcaacgggaatcaccatcattccttttcttcttcctctgcttctcatagacatgttagctacagctgcggtatctgcgggtatgagttgaacttgagctcctccaatcgaaacacgtcaacaattggctctaaatatgggaaatccataaagcgagggaaaatctcattcttcttcatcgatgagagtagatttactcaggttgatgaattccaatgctttcccttcttttcaaaaaactcccttggtttgttccgccagagaactgcacttctttgccgcaagtgtggtaatcacattggaattgcttatgctgatgaagcttcagcttatccacttgtagcagacggatctgactcttcctcagtcagtgaagttttcaaacgtcgaaaatatgatgttaaaatccgtgccttgcagccttcttctgccgagcagtttagcattccactttacacctga

SEQ ID NO: 571 - protein, 164 aa, Populus balsamifera subsp. trichocarpa
  misc_feature: Ceres Annot ID no. 1452096
  misc_feature: Bit score of 385.9 for HMM based on sequences of Figure 1
  misc_feature: Functional Homolog Of SEQ ID NO. 554
MEKSTAFREAYLNGNHHHSFSSSSASHRHVSYSCGICGYELNLSSSNRNTSTIGSKYGKSIKRGKISFFFIDESRFTQVDEFQCFPFFSKNSLGLFRQRTALLCRKCGNHIGIAYADEASAYPLVADGSDSSSVSEVFKRRKYDVKIRALQPSSAEQFSIPLYT

SEQ ID NO: 572 - DNA, 897 bp, Glycine max
  misc_feature: Ceres Clone ID no. 1645639
  misc_feature: Encodes the peptide sequence at SEQ ID NO. 573
ccttcattcatctcaaaatgaaaaattccgtgtttaacaacaaagcacaagttcaccaaaatcgaacttgctcctcctattcctattcctactcttctcagagggatgtctgctacagttgtggtacatgcgggtatgagcttaacctatcctcctctaaccggaatatatcatccatcggttcaaaatatgggaaatccataaagcgaggcattatatcattcctcaacgttgatgacagcagattcacccgcgccgatgaaattgaattcgccccatatttttcaaagcacaagtggggtttgttccgccgaaaaaccaagcttctttgtcgcaagtgttgcaaccatattggatatgcctacaacgatcgcacttcatcattttttcccttcgtatcaaacagaacagaaccatcaccacccaccgaagcatcaaattcaagtccaatgaaatacgatattcgcattcgtgctttacaaccttcatcttctcaagaacatggaatcactgtgttggcttaaaatttcaaatacgcggtaaaaaattgttatcactaactacggggaggttgtgatttcattttttttttttttttatagatttgaagttctgttttggcaagggtgttgtgttcccctttccctgtgtctcaagtgtgattaatatacacttgtatactagaagtagtagctgtggaatttttggaatgttaagttaaattttgcaaaacaacgaagatagaaagaatatttatggtggtgctacttcgtaaatcagaagatattatctagttttgaatagtcagatatcaggagtggattgcccggcctcacaatgtatgaatataatgttgatatataatcgtatattgtatggtataatattattttcagc

SEQ ID NO: 573 - protein, 168 aa, Glycine max
  misc_feature: Ceres Clone ID no. 1645639
  misc_feature: Bit score of 298.1 for HMM based on sequences of Figure 1
  misc_feature: Functional Homolog Of SEQ ID NO. 554
MKNSVFNNKAQVHQNRTCSSYSYSYSSQRDVCYSCGTCGYELNLSSSNRNISSIGSKYGKSIKRGIISFLNVDDSRFTRADEIEFAPYFSKHKWGLFRRKTKLLCRKCCNHIGYAYNDRTSSFFPFVSNRTEPSPPTEASNSSPMKYDIRIRALQPSSSQEHGITVLA

SEQ ID NO: 574 - protein, 154 aa, Vitis vinifera
  misc_feature: Public GI ID no. 157344920
  misc_feature: Bit score of 220.8 for HMM based on sequences of Figure 1
  misc_feature: Functional Homolog Of SEQ ID NO. 554
MEMLAGEDDRSSGFHHLHLSCSLRDVHYSCGSCGYQLNLNSCNRTSVLGSKYEKSIKKGIISFFSIDETRFTQTNELRCLPYFNSRCSWGLFRRRSKLLCKKCGNHIGNAYKTNNRSGKLDSSAWDGISDSSRIYDIKICALQPSSSLESDAFV

SEQ ID NO: 575 - protein, 157 aa, Oryza sativa subsp. japonica
  misc_feature: Public GI ID no. 115440865
  misc_feature: Bit score of 302.5 for HMM based on sequences of Figure 1
  misc_feature: Functional Homolog Of SEQ ID NO. 554
MVRSLDSYPSIKDVTYSCGYCGYALNLSSSTRNTANIGSKYGKQIKKGVVSFFAVDESRFTQADEVTCVPYFHSRRSWGLFRRRSRLLCRKCGGRIGSAYEEDEPAAAALPACDGPDDLRTTSSGSSGSASSQKNYVIKINALQPSSDDSDAVAFTL

SEQ ID NO: 576 - DNA, 761 bp, Zea mays
  misc_feature: Ceres Clone ID no. 340925
  misc_feature: Encodes the peptide sequence at SEQ ID NO. 577
ggccaagccaagcaatcaagcgggggtgtcggtccgccgagcggagggcgagcatggtgagggccctcgaccgctactcctccggcaaagatgtcgcctacagctgtggatactgcggcttcgcgttgaacttgagctcctccacgcggaacacggccaacattgggtccaagtacggcaagcacatcaggaaaggcgtcgtctccttcttcgcgatcgacgagagccgcttcacgcaggccgacgaggtgagctgcacgccgtacttccgctccagccgttcgtggggcttcttcaggaacaggacgcggctgctctgccggaagtgcggtggccacactggttatgcctacgaagacgagggtcccgccctgcgcgacgaggggccagcagatgacctggacatgagctccagctccaggggaagcagcacgtcccctcggaagaagtatgttatcaagatcagtgcgctgcggccgttatcagacgactctggtgctctcctctccccgtgatggcgatctggattctgagctgcagccatgtgtaaattaagggatagtggttctcttcagttacttcgtgagcagaatttttttggtttattgtacgttacaagttacatcatgttcatatttattttgtgtaataaggtgtggttgatgtaatatcttgtttatgattaggtcatggagataatagacatctagctttagcattgatgttcctgtttgctagtcagtaaattaagggatttgatc

SEQ ID NO: 577 - protein, 153 aa, Zea mays
  misc_feature: Ceres Clone ID no. 340925
  misc_feature: Bit score of 299.1 for HMM based on sequences of Figure 1
  misc_feature: Functional Homolog Of SEQ ID NO. 554
MVRALDRYSSGKDVAYSCGYCGFALNLSSSTRNTANIGSKYGKHIRKGVVSFFAIDESRFTQADEVSCTPYFRSSRSWGFFRNRTRLLCRKCGGHTGYAYEDEGPALRDEGPADDLDMSSSSRGSSTSPRKKYVIKISALRPLSDDSGALLSP

SEQ ID NO: 578 - DNA, 516 bp, Sorghum bicolor
  misc_feature: Ceres Annot ID no. 8669404
  misc_feature: Encodes the peptide sequence at SEQ ID NO. 579
atggacaggtctctcgacagaaactcctccatcaaggacgtcacttatagctgcgggtactgcggctacgcgctgaacctgagctcctcggcgcgggacacggagggcatcgggtgctccaagtaccgcaagcagatcaagaagggcgtcgtcgccttcgtcgcggtggacgagacccggttcacgctcgccgacgaggtcacctgcatgccctacttccgctccgcccgctcctggggcctcttcaggaggcgggcgcgcctgctctgccgcaagtgcggcggacgcatcggcaacgcctacgaggaggaggacgacgccagggactactccagctccagcctcttcgacggcgacggcgacggctcctcggatgacatgcgccggagctccggcttgggctcgggccgcagcagcatcgtgtcgtcgagccagaagaactacgtgatcaagatcagcgcgctgcagccgtcgtcagatgattctgctgctgttgttcccttcacacatcgatga

SEQ ID NO: 579 - protein, 171 aa, Sorghum bicolor
  misc_feature: Ceres Annot ID no. 8669404
  misc_feature: Bit score of 236.2 for HMM based on sequences of Figure 1
  misc_feature: Functional Homolog Of SEQ ID NO. 554
MDRSLDRNSSIKDVTYSCGYCGYALNLSSSARDTEGIGCSKYRKQIKKGVVAFVAVDETRFTLADEVTCMPYFRSARSWGLFRRRARLLCRKCGGRIGNAYEEEDDARDYSSSSLFDGDGDGSSDDMRRSSGLGSGRSSIVSSSQKNYVIKISALQPSSDDSAAVVPFTHR

SEQ ID NO: 580 - DNA, 619 bp, Gossypium hirsutum
  misc_feature: Ceres Clone ID no. 100028078
  misc_feature: Encodes the peptide sequence at SEQ ID NO. 581
attcagagaggatgtcccaagctcacgtctcttacagctgtggatcttgtggttaccctttgaacttgacctcttccaatcgaatcgccaccagcataggctctgaatatcgcaaatccgtagagaaaggtcttatctcctttctatctgttgatcttagtcgattcacacaagtcgacgaggtacattgctttcctgtcagttggggccgtcatcgatcaaaaactaaactactttgccgtaaatgtggggttcatgtagggtatgggtatggagatgcgcctgccctttgtggttttgactctcccgactcatctagtgctgcttttaggaagtttacaataaagatccgagctctacagccttcagacgagtgctaacaaggttgacatgggagattctttatggacggtgttacttcgatcatgctcctacctgatgattgcctctgttttattttcaattttcttgactgtaggaatgaccgtgaatcatttggcctaacttgccaccgctggcttaatattcaaaacttgaatcgtcggtccttgcaatttccatgttctttcggcattgttggcccttcctcgttatctcagagctgtaccgatatcaactc

SEQ ID NO: 581 - protein, 122 aa, Gossypium hirsutum
  misc_feature: Ceres Clone ID no. 100028078
  misc_feature: Bit score of 148.3 for HMM based on sequences of Figure 1
  misc_feature: Functional Homolog Of SEQ ID NO. 554
MSQAHVSYSCGSCGYPLNLTSSNRIATSIGSEYRKSVEKGLISFLSVDLSRFTQVDEVHCFPVSWGRHRSKTKLLCRKCGVHVGYGYGDAPALCGFDSPDSSSAAFRKFTIKIRALQPSDEC

SEQ ID NO: 582 - DNA, 471 bp, Populus balsamifera subsp. trichocarpa
  misc_feature: Ceres Annot ID no. 1503869
  misc_feature: Encodes the peptide sequence at SEQ ID NO. 583
atggaatcatggattgggtttagatgtgtgcttgaaatagtgtgttcatttcttcgaaaaagaaagaaaagctgcggttcttgtgggtatcagttaaacttgaactcttgcaaccggaacactccagatattggagttaattacaagaaatccataaagaaaggaagtatttcattcttcagcattgatgaaaccaggttcactcaaattgaagaacttcgatgtacaccatacttcaattccatgcgttcctggggtttattccagcgaagaaccaagcttctttgttacaaatgtggaaatcatcttgggattgcttacaaagagaataatacctcttcctcccctctcagattggggaaatgtcgatcagatttgatctcttgggatgggatttctgatgccagaatttatgttatcaagatacgttccttgcagcctgcttctactgaggactatagtttgagctga

SEQ ID NO: 583 - protein, 156 aa, Populus balsamifera subsp. trichocarpa
  misc_feature: Ceres Annot ID no. 1503869
  misc_feature: Bit score of 190.6 for HMM based on sequences of Figure 1
  misc_feature: Functional Homolog Of SEQ ID NO. 554
MESWIGFRCVLEIVCSFLRKRKKSCGSCGYQLNLNSCNRNTPDIGVNYKKSIKKGSISFFSIDETRFTQIEELRCTPYFNSMRSWGLFQRRTKLLCYKCGNHLGIAYKENNTSSSPLRLGKCRSDLISWDGISDARIYVIKIRSLQPASTEDYSLS

SEQ ID NO: 584 - DNA, 453 bp, Populus balsamifera subsp. trichocarpa
  misc_feature: Ceres Annot ID no. 1525651
  misc_feature: Encodes the peptide sequence at SEQ ID NO. 585
atgacaaaagaatttactgggggtggtcctttcaatcaaccagatcctgctaaaggggagcgtaaaacaaggcaatctgcaagaattaagcttctgtttgagctgcaaagctgtggctcttgtggataccccttgaatttaacatcttccaatcgaatcacctccaacataggttctggatatcagaaatctataaagaaaggttatatctccttcctttctgttgatcttagtcgattcacacaggttgatgaggtaaactgtcttcctgtgtcttggggtcgttatcattcaaaaagtaaacttctttgtcgtaaatgtggggttcacgtaggctatggatatggagattcgcccgctctatgtggttttgactctcccaactcatcaagctcagcttataaaaaatttaccataaagatccgagctctacagccttcagaagagtgctaa

SEQ ID NO: 585 - protein, 150 aa, Populus balsamifera subsp. trichocarpa
  misc_feature: Ceres Annot ID no. 1525651
  misc_feature: Bit score of 143.5 for HMM based on sequences of Figure 1
  misc_feature: Functional Homolog Of SEQ ID NO. 554
MTKEFTGGGPFNQPDPAKGERKTRQSARIKLLFELQSCGSCGYPLNLTSSNRITSNIGSGYQKSIKKGYISFLSVDLSRFTQVDEVNCLPVSWGRYHSKSKLLCRKCGVHVGYGYGDSPALCGFDSPNSSSSAYKKFTIKIRALQPSEEC

SEQ ID NO: 586 - DNA, 1076 bp, Panicum virgatum
  misc_feature: Ceres Clone ID no. 2031281
  misc_feature: Encodes the peptide sequence at SEQ ID NO. 587
aaatcgcccgaggaaaagcgcgcggcagggcaggagacgccgatcccccgtgtccgttggcgagcgagaccgaggcccgaccaaacaaccgccccgcctttttagccagccggccgttcgtcgcccccgctctcccccccactcgccccacgtctcctctgtctctccgatcggcaggagggaaaagtggacggctccagcgaagcgagcgccaccgtcgccttcgcctcgccatggagaggtctctcgacagcagctactccgcctccatcaaggacgtcacatacagctgcgggtactgcggctacgcgctgcacctgagctcctcggcgcgggacacggcgggcatcggctccaagtaccgcaagcagatcaagaagggcgtggtcgccttcgtcgccgtcgacgagagccgcttcacgctcaccgacgaggtcacctgcatgccctacttccgctccaggcgtgcctggggcctcctcaggaagcgttcgcgcctgctctgccgcaagtgcggcggccgcatcggcgacgcctacgaggaggaggacagggactccggcctcagcgacggcgacgccttctcggacgacctgcgcgcgagcttgggctccggtggcagcggcagcagcgcgtcgagccagaggaactacgtgatcaagatcagcgcgctgcagccgtcgtcagacgattctgacgcagctgccttcacactatgatgaagatagatggcgtcgggttgctgcaaggcgctcttcttccagcttggttgaattcgacttttgtgttatcagggatgcgactttgtaagcgcgggaggaaatacagcaagaaagagcttggcacagctgagaacttttcagatggtaaccaactgcatgctgttttcagacatcttgctgtcagtagtgctcttcgtttcctatgtaaatttgtgaaatgtacagcttggttattgaatttttctttgtattaggaaatgattaggtttgctgtatgttagttgatcccatagaatttgtactgtgtcataactcatgatccaccacggttgcaattttgagtagtcttgcttc

SEQ ID NO: 587 - protein, 161 aa, Panicum virgatum
  misc_feature: Ceres Clone ID no. 2031281
  misc_feature: Bit score of 255.8 for HMM based on sequences of Figure 1
  misc_feature: Functional Homolog Of SEQ ID NO. 554
MERSLDSSYSASIKDVTYSCGYCGYALHLSSSARDTAGIGSKYRKQIKKGVVAFVAVDESRFTLTDEVTCMPYFRSRRAWGLLRKRSRLLCRKCGGRIGDAYEEEDRDSGLSDGDAFSDDLRASLGSGGSGSSASSQRNYVIKISALQPSSDDSDAAAFTL

SEQ ID NO: 588 - DNA, 1157 bp, Zea mays
  misc_feature: Ceres Clone ID no. 483742
  misc_feature: Encodes the peptide sequence at SEQ ID NO. 589
aggatacctgattaaagaattgcttaactagcagcggcgcaaagcctcggccggaggccaatcctccgtgtccggtcgggcgcaacccgaccaaacaacttccttttaagcaaaccgctcgcgttcctgaattcctgacccccgctctctctcccccacccgcactcgccccacgtctcctctctcccgtcccgtctgctctctgatcagcaggagagaaaggtggatgcgccagcgaagcgagcaccgtccctaatcgtcggccatggagaggtctctcgacagctactcctccatcaaggacgtcacctacagctgcgggtactgcgggtacgcgctgaacctgagctcctcggcgcgggacacggagggcatcgggcccaagtaccgcaagcagatcaggaagggcgtcgtcgccttcgtcgcggtcgacgagagccggttcacgctggcccacgagctcacctgcacgccctacttccgctccgcccgctcctggggcctcttcaggaggcggtcgcgcctgctctgccgcaagtgcggggggcacatcggcagcgcctacggctacggggaggaggaggaggacgccagggactccagctcctccagcctcttcggcggtgacggctcctcggatgacacgcgcccgagctccggctcgggccgcagcagcgtcgcgtcgagccagaagagctacgtggtcaggatcagcgcgctgcagccgtcttcggatgactctgctgtcgttcccttcacgcatcgatgatgcattgcaggtgtcgagttggtgtgccgtgttcttcttccagcctggatgaatttgaatttgctgtaacctgggatggcgatggactgcaggaggacgaagtggagcaagggaagatatttcttggcgtgtctagacttttcagaggtttgatcagctgcatgctgctttcagtcatcttgctgtttgtaatgcctctgtgtttcctctgtacattggtaagtatagagcaacatggtttttgaaattttggttggtgtcgtgtaaatgattaaaggttttctgtatttcgattgattctatagcgtttgtattatgtcatagaattgaaattttgattagtcttgtactcttgtctcgcttgcatgtgtggatgttttagcttccc

SEQ ID NO: 589 - protein, 167 aa, Zea mays
  misc_feature: Ceres Clone ID no. 483742
  misc_feature: Bit score of 231.0 for HMM based on sequences of Figure 1
  misc_feature: Functional Homolog Of SEQ ID NO. 554
MERSLDSYSSIKDVTYSCGYCGYALNLSSSARDTEGIGPKYRKQIRKGVVAFVAVDESRFTLAHELTCTPYFRSARSWGLFRRRSRLLCRKCGGHIGSAYGYGEEEEDARDSSSSSLFGGDGSSDDTRPSSGSGRSSVASSQKSYVVRISALQPSSDDSAVVPFTHR

SEQ ID NO: 590 - DNA, 674 bp, Zea mays
  misc_feature: Ceres Clone ID no. 100802111
  misc_feature: Encodes the peptide sequence at SEQ ID NO. 591
cgcgccccactccccagacgccgtcgcctagatccatgagacttcccgatcttcctgcggcccgaggatgtcccagagcgacgtcgactacagttgcggatcttgtggataccctctaaacctttcatcttctaaccgaagcacatctgaagtaggctcatataagaagtctctgaagaaaggactgatttcattcatttctgttgatctcagccgatttactcaggtggacgaggtatcttgctttcccctcacctggcgtggttacaggccaaaaactaagcttctgtgccgaatatgtggggcatctattggctacggatacggtgagccggctgttttgtgtagttttgatccagcaagttcatcttcctccagtacatcccagaagtatttaataaagatccaagcactccaaccttcagacaggactcagtaagtgaaatatggaaagagaggaaataggtgtcagcctagagaactccatcagttacctatctgatgattgcttgctttctatatttaacaagctagaaagcgggtcagagaggagtgctttcggtttaacttgcaagaattggttcaaggttcggaaccttggccggaaatcactaacattccattgttcttttaatcctgccatagacaaggagcatgccaagtgcatccccaag

SEQ ID NO: 591 - protein, 123 aa, Zea mays
  misc_feature: Ceres Clone ID no. 100802111
  misc_feature: Bit score of 137.0 for HMM based on sequences of Figure 1
  misc_feature: Functional Homolog Of SEQ ID NO. 554
MSQSDVDYSCGSCGYPLNLSSSNRSTSEVGSYKKSLKKGLISFISVDLSRFTQVDEVSCFPLTWRGYRPKTKLLCRICGASIGYGYGEPAVLCSFDPASSSSSSTSQKYLIKIQALQPSDRTQ

SEQ ID NO: 592 - DNA, 799 bp, Triticum aestivum
  misc_feature: Ceres Clone ID no. 1460255
  misc_feature: Encodes the peptide sequence at SEQ ID NO. 593
atcagctcgccaccagcaagcaaccgctctttttagtccccactcgctccacgatccctcccccactccggccggccacgcgcaaagcgaaacgctccccgactccggccaagagctccagcgccgccgccgccgaccgtcgttcgtccatatggtgaggtccaactccatcgacagctgctactcctccatccaggacgtcacctacagctgcgggtactgcggctacgcgctgaacctgagctcggcggcgcggaacacggccaacatcggctccaagtacggcaagcagatcaggaagaagggcatcgtggccttcgtcgccgtcgacgagacgcgcttcacgcaggccgacgaggtcacctgcgcgccccgcctccgcccctggacctggcgcctcttccggcggaggtcgcgcctgctctgcggcaagtgcggcggccgcatcggcgccgcctacgaggtcgacgaggaggacgaggaccccgccggcctctccgcgtgcggcggctcggacgacgacgacgacgacctgcggacgagcccgggcgatgatgtcggcgcgtccagaaggaggaactacctgatcaggatcggcgcgctgcagccctcgacggacgatcctcctcctgccgatcccttctctctatgatatgatatgatattgatatgacacaccgctgctgaattttgttcctttgttcatagtggaagacgacccgagagcttgatgtgtgtaagttgatcctgctatagtttttgtgtcctggtaatggagtgagccatggttgcaattttg

SEQ ID NO: 593 - protein, 166 aa, Triticum aestivum
  misc_feature: Ceres Clone ID no. 1460255
  misc_feature: Bit score of 204.0 for HMM based on sequences of Figure 1
  misc_feature: Functional Homolog Of SEQ ID NO. 554
MVRSNSIDSCYSSIQDVTYSCGYCGYALNLSSAARNTANIGSKYGKQIRKKGIVAFVAVDETRFTQADEVTCAPRLRPWTWRLFRRRSRLLCGKCGGRIGAAYEVDEEDEDPAGLSACGGSDDDDDDLRTSPGDDVGASRRRNYLIRIGALQPSTDDPPPADPFSL

SEQ ID NO: 594 - DNA, 870 bp, Arabidopsis thaliana
  misc_feature: Ceres Clone ID no. 26006
  misc_feature: Encodes the peptide sequence at SEQ ID NO. 595
aaaaagtacgaaaggaaaatatgagtgaggagaagaggaagcaacacttcgtgctagtacatggtgcgtgccacggcgcatggtgctggtacaaggttaagcctcttctcgaggctttgggccatcgtgtaaccgccttagacctagctgcttccggtatagacacaaccaggtcaatcactgacatttctacatgtgaacaatattctgagccattgatgcagctaatgacttcattgccgaatgatgagaaggttgtactcgttggtcatagctttggaggtttgagtttagccttagccatggataagtttcccgataaaatctctgtctctgtcttcgtgactgcattcatgcccgacaccaaacactcaccatcgttcgtcgaggaaaagtttgcaagcagcatgacaccagaaggatggatgggctctgagctcgagacatatggttcagataattccggcttgtctgtgttcttcagcaccgacttcatgaagcaccgtctctaccaactttctcctgtggaggatcttgagcttggattgcttctaaagaggcctagttcattgtttattaatgaattatcgaagatggagaacttttctgagaaagggtatggatctgttcctcgagcttacattgtgtgcaaagaggacaacattatctcggaagaccatcaacgatggatgatccataattatccggcgaatttagtgattgagatggaagagacggatcatatgccaatgttttgcaaacctcaagtactaagtgaccatctattggcaatcgctgacaatttctcttaaataatattttgatgaaaatgtatttggagtggatacaataaaaatgtgttctaaatgg

SEQ ID NO: 595 - protein, 263 aa, Arabidopsis thaliana
  misc_feature (35)..(257): Pfam Name: Abhydrolase_1 Pfam Description: alpha/beta hydrolase fold
  misc_feature: Ceres Clone ID no. 26006
  misc_feature: Bit score of 698.2 for HMM based on sequences of Figure 8
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQVLSDHLLAIADNFS

SEQ ID NO: 596 - DNA, 1072 bp, Triticum aestivum
  misc_feature: Ceres Clone ID no. 644331
  misc_feature: Encodes the peptide sequence at SEQ ID NO. 597
atcggagccacagctacagctcaagcacagaaaaacagccacaaaaccccacccatgcacatggaggcttgtgcgggccaagctagcagcgcgcacatcgtcctggtgcacggcgcatgcctcggcggctggtcctggttcaaggtggcgacgcggctcaggtcggccgggcaccgcgtcagcacgcctgacctcgcggcgtccggcgtcgaccccaggccgctgcgcgaggtgccgacgttccgcgactacaccaagccgctgctggacctcctggagtccctcccgtccggcgagaaggtggtgctcgtcggccacagcctcggcggcgtgaacgtcgccctcgcctgcgagctgtttccggagaagatcgccgctgcggtgttcgtcgccgccttcatgccggaccacaggtcgccgccgtcgtacgtccttgaaaagttcgtggaggggagaacgctggactggatggacacggagtttaagcctcaagatcctgaggggaagctgcctacttccatgctgttcgggccgctggtcactcgtgcaaagttcttccagttgtgttcgccggaggacctcacgctgggacgatccctgatgagggtcaactccatgttcgtggacgacctgaggctgcagccgccgcacaccgaggcccgctacgggtcggtgcgcaaggcgtacgtcgtcttcaaggacgaccacgccatcgtcgagcagttccagcggtggatggtgcacaactaccccgtggacgaggtgatggaaatcgatggcgcggaccacatggcgttgctctcgacgccgaccgagctggcgcgctgcctcgctgacatcgccgtcaagtatgctgcttgacttcctcgcaaaaaataaaagaaaagtctgctgcttgacgatggtgtggcgcacgttgcttgctgatctatacatctgtctaccttatggtttgtcccgttcgttaggtttcagagacttctactgcactctatttcagaccgataatgtttcaacatcgtatcgtggtgcatgtaactttgctatttaatatttgaagataaatgttggc

SEQ ID NO: 597 - protein, 266 aa, Triticum aestivum
  misc_feature (38)..(259): Pfam Name: Abhydrolase_1 Pfam Description: alpha/beta hydrolase fold
  misc_feature: Ceres Clone ID no. 644331
  misc_feature: Bit score of 483.0 for HMM based on sequences of Figure 8
  misc_feature: Functional Homolog Of SEQ ID NO. 595
MEACAGQASSAHIVLVHGACLGGWSWFKVATRLRSAGHRVSTPDLAASGVDPRPLREVPTFRDYTKPLLDLLESLPSGEKVVLVGHSLGGVNVALACELFPEKIAAAVFVAAFMPDHRSPPSYVLEKFVEGRTLDWMDTEFKPQDPEGKLPTSMLFGPLVTRAKFFQLCSPEDLTLGRSLMRVNSMFVDDLRLQPPHTEARYGSVRKAYVVFKDDHAIVEQFQRWMVHNYPVDEVMEIDGADHMALLSTPTELARCLADIAVKYAA

SEQ ID NO: 598 - protein, 263 aa, Arabidopsis thaliana
  misc_feature (34)..(257): Pfam Name: Abhydrolase_1 Pfam Description: alpha/beta hydrolase fold
  misc_feature: Public GI ID no. 15227859
  misc_feature: Bit score of 482.4 for HMM based on sequences of Figure 8
  misc_feature: Functional Homolog Of SEQ ID NO. 595
MEKNNKKRFVLVHGLCHGAWCWYKVKTHLEAVGHCVTAVDLAASGINMTRLEEIQTLKDYCKPLLELLNSLGSDDDKVILVAHSMGGIPAALASDIFPSKIATIVFLTAFMPDTRNLPAYVYQKLIRSVPQEGWLDTVFGTYGKHECPLEFALFGPKFMAKNLYQLSPVQDLELAKMLVRVNPIITNNLAGTRSFSEEGYGTVTRIYIVCGEDMAVPEDYQWWMIKNFPPKEVMEIKCADHMAMFSKPHKLCALLVEIACKYA

SEQ ID NO: 599 - DNA, 780 bp, Populus balsamifera subsp. trichocarpa
  misc_feature: Ceres Annot ID no. 1504349
  misc_feature: Encodes the peptide sequence at SEQ ID NO. 600
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 600 - protein, 259 aa, Populus balsamifera subsp. trichocarpa
  misc_feature (36)..(122): Pfam Name: Abhydrolase_1 Pfam Description: alpha/beta hydrolase fold
  misc_feature: Ceres Annot ID no. 1504349
  misc_feature: Bit score of 517.3 for HMM based on sequences of Figure 8
  misc_feature: Functional Homolog Of SEQ ID NO. 595
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 601 - DNA, 867 bp, Arabidopsis thaliana
  misc_feature: Ceres Annot ID no. 1265088
  misc_feature: Encodes the peptide sequence at SEQ ID NO. 602
gaagaaaatgagtgaggaggagaggaagcaacacgtcgttctagtacatggtgcttgccatggcgcctggtgctggtacaaggttaagccgcagctcgaggcttctggccaccgcgtaaccgccgtagatctagctgcctccggtatagacatgaccaggtcaatcacagatatatccacatgcgaacaatactcagagccattgatgcagctaatgacctcactaccagatgatgagaaggttgtgcttgttggtcatagcttaggaggtttgagtttagctatggccatggatatgtttccgaccaaaatctctgtttctgtctttgtgactgctatgatgccagacaccaaacactcaccatccttcgtatgggataagctaagaaaagaaacttcacgagaggaatggttagacaccgtgtttacgagcgagaaacctgattttcctagcgagttttggatttttggaccagaattcatggccaagaacttgtatcagttgtctccagtccaagatcttgaattggcgaaaatgttggtgagggcaaacccattgattaagaaagatatggcagagagaagaagcttcagtgaggaaggatacggatccgttacacgtatatttattgtatgcggaaaggatcttgtgtcacccgaagattaccagcgatcgatgatcagcaactttcccccaaaagaagtaatggagatcaaagacgcagatcatatgccaatgttctccaagcctcaacaactatgtgctcttctcttggagattgcaaataaatatgcctaaataaatctgaaatatcatcatcactgcatatcaattacaaattcagtgtccaccacaataataagcca

SEQ ID NO: 602 - protein, 263 aa, Arabidopsis thaliana
  misc_feature (35)..(257): Pfam Name: Abhydrolase_1 Pfam Description: alpha/beta hydrolase fold
  misc_feature: Ceres Annot ID no. 1265088
  misc_feature: Bit score of 556.5 for HMM based on sequences of Figure 8
  misc_feature: Functional Homolog Of SEQ ID NO. 595
MSEEERKQHVVLVHGACHGAWCWYKVKPQLEASGHRVTAVDLAASGIDMTRSITDISTCEQYSEPLMQLMTSLPDDEKVVLVGHSLGGLSLAMAMDMFPTKISVSVFVTAMMPDTKHSPSFVWDKLRKETSREEWLDTVFTSEKPDFPSEFWIFGPEFMAKNLYQLSPVQDLELAKMLVRANPLIKKDMAERRSFSEEGYGSVTRIFIVCGKDLVSPEDYQRSMISNFPPKEVMEIKDADHMPMFSKPQQLCALLLEIANKYA

SEQ ID NO: 603 - protein, 250 aa, Arabidopsis thaliana
  misc_feature (31)..(244): Pfam Name: Abhydrolase_1 Pfam Description: alpha/beta hydrolase fold
  misc_feature: Bit score of 565.8 for HMM based on sequences of Figure 8
  misc_feature: Functional Homolog Of SEQ ID NO. 595
MMKQHFVLVHGSCLGAWCWYKVKPLLEASGHRVTALDLAACGIDTRSITDISTCEQYSEPLIQLMTSLPNDEKVVLVGHSYGGLTLAIAMDKFPDKISVSVFVTSFMPDTKNSPSFVLEKFASTMTPEDWMGSELEPYVVFSAEFTKHRILQLSPIEDLELRLLLKRPGSLFLNDLSRMKNFSEKGYGSVPRAYIVSKDDHTISEEYQRWMIDNYPPNLVIEMEGTDHLPLFCKPQLLSDHLLAIADKFS

SEQ ID NO: 604 - protein, 263 aa, Oryza sativa subsp. indica
  misc_feature (36)..(257): Pfam Name: Abhydrolase_1 Pfam Description: alpha/beta hydrolase fold
  misc_feature: Public GI ID no. 125527987
  misc_feature: Bit score of 481.1 for HMM based on sequences of Figure 8
  misc_feature: Functional Homolog Of SEQ ID NO. 595
MADGKVACKHLVLVHGACIGGWTYFKVATRLRSAGYRVTAPDLGASGVDPRPLREVPTFRDYTAPLLGLLGSLPPGEKVVLVGHSLGGINVALAAELFPDKIAAAVFLCAFMPDHTSRPSHVLEKFIEGKWLDWMDTEFKPQDAEGKLPTSMLFGPQIAQERLMQLCSPEDVTLAGSLLRMSSMFVEDLQKQQPFTEGRYGSVRKVYVVVNQDLAIPEGFQRWMIGNSPVDEVKEIDAADHLVMLSRPDELARCLADIAESYA

SEQ ID NO: 605 - protein, 267 aa, Citrus sinensis
  misc_feature (37)..(261): Pfam Name: Abhydrolase_1 Pfam Description: alpha/beta hydrolase fold
  misc_feature: Public GI ID no. 14279437
  misc_feature: Bit score of 736.8 for HMM based on sequences of Figure 8
  misc_feature: Functional Homolog Of SEQ ID NO. 595
MEEVVGMEEKHFVLVHGVNHGAWCWYKLKARLVAGGHRVTAVDLAASGINMKRIEDVHTFHAYSEPLMEVLASLPAEEKVILVGHSLGGVTLALAGDKFPHKISVAVFVTAFMPDTTHRPSFVLEQYSEKMGKEDDSWLDTQFSQCDASNPSHISMLFGREFLTIKIYQLCPPEDLELAKMLVRPGSMFIDNLSKESKFSDEGYGSVKRVYLVCEEDIGLPKQFQHWMIQNYPVNEVMEIKGGDHMAMLSDPQKLCDCLSQISLKYA

SEQ ID NO: 606 - protein, 262 aa, Brassica napus
  misc_feature (35)..(256): Pfam Name: Abhydrolase_1 Pfam Description: alpha/beta hydrolase fold
  misc_feature: Bit score of 650.2 for HMM based on sequences of Figure 8
  misc_feature: Functional Homolog Of SEQ ID NO. 595
MSENKRKQHFVLVHGSCHGAWCWYKVKPLLEAAGHQVTALNLAASGIDTRSITDISTCEQYSEPLLNLLKSLPDDEKVVLVGHSFGGLSLAIAMDKFPDKISVSVFLSAFMPDTKHSPSFVLEKFGSSMAHEAWMGTEFKPYGSDNSGLSMFFSFEFMKLGLYQLSPVEDLELGLLLKRPGSLFVSNLSKMKNFSDEGYGNVPRAYIVCKEDKGIPEAFQRWLIDNFPVNIVMEIDETDHMPMFCKPQQLCDHFMEIADKFV

SEQ ID NO: 607 - DNA, 953 bp, Brassica napus
  misc_feature: Ceres Clone ID no. 1065042
  misc_feature: Encodes the peptide sequence at SEQ ID NO. 608
aggaaataatatacaaaatcaaaggttaagaaaaaaaatgggtgaggagaagaatcagcagcacttcgtgctagtacatggtgcatgccacggcgcgtggtgctggaacaaggttaagccgcttctcgaggcctccggccaccgcgtaaccgccttagacctagctgcttcgggtatagacacaaccaggtctatcactgagatctccacatgcgaacaatactctgagccattgatacagctaatcgcctcattaccaagtgatgagaaggttgtgctcgttggtcatagctttggagggttcagcttagccatggccatggataagtttccagacaaaatctctgtctcagtcttcgtgactgctttcatgcccgataccaaacactcaccatcgttcgtcgtggataagtttaaacgggatacgccaccagaagcatggttgggctcggagttcaaatcatatggctcagacaattccggtgtgtcaatgtctttcagcactgagttcatgaagcacgctctctatcaactttctcctgttgaggatattgagcttggattgcttttaaagaggcccggatcattgttcatcaacgatttatccaaggtggagaacttttcggacaaagggtatggatctgttcctcgagcttacattgtgtgcaaagaggacaaaacaattacaaaagaaattcagtggtggatgatcgataattatccgacgaaagtagtgaaggagatggaggacacagatcatatgccaatgttctgcaagcctcagttactaagtgactatctcttggaaatcgcggaaaaattagcttaaattatcttgttatgaaaatgtatttggatacaaataagtgttgtcctgcaaatgggtctttctaaagatcaagacttttatcgcgttcaaatgtttgacataatttaaaataaacttaacagtc

SEQ ID NO: 608 - protein, 263 aa, Brassica napus
  misc_feature (35)..(257): Pfam Name: Abhydrolase_1 Pfam Description: alpha/beta hydrolase fold
  misc_feature: Ceres Clone ID no. 1065042
  misc_feature: Bit score of 641.8 for HMM based on sequences of Figure 8
  misc_feature: Functional Homolog Of SEQ ID NO. 595
MGEEKNQQHFVLVHGACHGAWCWNKVKPLLEASGHRVTALDLAASGIDTTRSITEISTCEQYSEPLIQLIASLPSDEKVVLVGHSFGGFSLAMAMDKFPDKISVSVFVTAFMPDTKHSPSFVVDKFKRDTPPEAWLGSEFKSYGSDNSGVSMSFSTEFMKHALYQLSPVEDIELGLLLKRPGSLFINDLSKVENFSDKGYGSVPRAYIVCKEDKTITKEIQWWMIDNYPTKVVKEMEDTDHMPMFCKPQLLSDYLLEIAEKLA

SEQ ID NO: 609 - protein, 265 aa, Vitis vinifera
  misc_feature (36)..(259): Pfam Name: Abhydrolase_1 Pfam Description: alpha/beta hydrolase fold
  misc_feature: Public GI ID no. 157329790
  misc_feature: Bit score of 751.6 for HMM based on sequences of Figure 8
  misc_feature: Functional Homolog Of SEQ ID NO. 595
MEVDRKQGRHFVLVHGACHGAWTWYKVKPRLEAAGHRVTALDMAASGINRKQIQEVHSMHEYSQPLLEMMAALPPNEKVILVGHSLGGLNLAVAMEKFPEKVSVAVFLTAFMPDTLHRPSYVLDQYVERTPNDAWLDTQFSPYGSSEKPQNSMFFGPEFISTKLYQLSPIEDLELVLALARPASLFLEDLAELKKFSNEGYGSVTSVFIRCDKDEGIRKEFQQWMIENSGGVKEVMNIKDADHMAMFSKPEELCACLLEVAHKYG

SEQ ID NO: 610 - protein, 272 aa, Arabidopsis thaliana
  misc_feature (53)..(266): Pfam Name: Abhydrolase_1 Pfam Description: alpha/beta hydrolase fold
  misc_feature: Public GI ID no. 15227861
  misc_feature: Bit score of 566.2 for HMM based on sequences of Figure 8
  misc_feature: Functional Homolog Of SEQ ID NO. 595
MYENGISFIISLLICGCVKSEEMMKQHFVLVHGSCLGAWCWYKVKPLLEASGHRVTALDLAACGIDTRSITDISTCEQYSEPLIQLMTSLPNDEKVVLVGHSYGGLTLAIAMDKFPDKISVSVFVTSFMPDTKNSPSFVLEKFASTMTPEDWMGSELEPYVVFSAEFTKHRILQLSPIEDLELRLLLKRPGSLFLNDLSRMKNFSEKGYGSVPRAYIVSKDDHTISEEYQRWMIDNYPPNLVIEMEGTDHLPLFCKPQLLSDHLLAIADKFS

SEQ ID NO: 611 - protein, 259 aa, Gentiana triflora var. japonica
  misc_feature (32)..(253): Pfam Name: Abhydrolase_1 Pfam Description: alpha/beta hydrolase fold
  misc_feature: Public GI ID no. 146272407
  misc_feature: Bit score of 686.5 for HMM based on sequences of Figure 8
  misc_feature: Functional Homolog Of SEQ ID NO. 595
MSPTKHFVAVHGVGHGAWVYYKLKPRIEAAGFKFTAIDLAAAGVNPKKLEEVNSLEEYCGPLFDVLAAVPEGEKVILVGHSGGGLSAAVGMEKFPKKISVAVFLNAIMPDTKNRPSYVMEEYTARTPIEAWKDTQFSAYGEPPITALLCGPEFISTSLYHLSPVEDHTLGKLLVRPGALFVEDLLKGAVKFTDEGFGSVPRVYVVATEDKTIPPEFQRWMIENNPVAEVKEIEGADHLPQFSKPDELTQVLVDIAKNHG

SEQ ID NO: 612 - DNA, 909 bp, Arabidopsis thaliana
  misc_feature: Ceres Clone ID no. 95094
  misc_feature: Encodes the peptide sequence at SEQ ID NO. 613
aactttataacgctattctcaaacaagcaaagaaccttaaccaaaaagaaaacgtctacggagacatatggagaggaaacatcacttcgtgttagttcacaacgcttatcatggagcctggatctggtacaagctcaagcccctccttgaatcagccggccaccgcgttactgctgtcgaactcgccgcctccgggatcgacccacgaccaatccaggccgttgaaaccgtcgacgaatactccaaaccgttgatcgaaaccctcaaatctcttccagagaacgaagaggtaattctggttggattcagcttcggaggcatcaacatcgctctcgccgccgacatatttccggcgaagattaaggttcttgtgttcctcaacgccttcttgcccgacacaacccacgtgccttctcacgttctggacaagtatatggagatgcctggaggtttgggagattgtgagttttcatctcatgaaacaagaaatgggacgatgagtttattgaagatgggaccaaaattcatgaaggcacgtctttaccaaaattgtcccatagaggattacgagctggcaaaaatgttgcataggcaagggtcatttttcacagaggatctatcaaagaaagaaaagtttagcgaggaaggatatggttcggtgcaacgagtttacgtaatgagtagtgaagacaaagccatcccctgcgatttcattcgttggatgattgataatttcaacgtctcgaaagtctacgagatcgatggcggagatcacatggtgatgctctccaaaccccaaaaactctttgactctctctctgctattgccaccgattatatgtaataatcttaaagtctgttttacttttttctcatcgttactaataaaacaaacccctttttccgggc

SEQ ID NO: 613 - protein, 258 aa, Arabidopsis thaliana
  misc_feature (32)..(252): Pfam Name: Abhydrolase_1 Pfam Description: alpha/beta hydrolase fold
  misc_feature: Ceres Clone ID no. 95094
  misc_feature: Bit score of 495.0 for HMM based on sequences of Figure 8
  misc_feature: Functional Homolog Of SEQ ID NO. 595
MERKHHFVLVHNAYHGAWIWYKLKPLLESAGHRVTAVELAASGIDPRPIQAVETVDEYSKPLIETLKSLPENEEVILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQGSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 614 - DNA, 985 bp, Musa acuminata
  misc_feature: Ceres Clone ID no. 1714893
  misc_feature: Encodes the peptide sequence at SEQ ID NO. 615
acttgccatagcacctccaaatgaattatggagaaggaaggggcgacgggagctgcaacaagaagcacataattctcgtccatggcgcttgccatggagcatggtcttggcacaaggtgacgacccagttgaggtccgctgggtaccaggttacggtgcccgacctcgcggcctccggcgtcgacgagcggcggttccaggacctgcgatcgttcatccactactcccagccgctcctggacatattggcctgcctccctcctggtgagagggtcattctggtaggccacagcctcggaggcctcaacatagctttggctatggacaggttccctgagaagatcgccgccgccgtcttcgtcaccgccttgatgccggattcagtcaacccgccctcctacgtcatggacaagcttaaaaaggaaaaaaccatgttattttggagcgacacacaatttggcttggtcggggacgaagataaaggtcccgtttccctgctattcggccccaaatttttatccaagctttacacgcgtagcccacccgaggatctgacgctggcgaggaccctcatgaggccttcttccttcttccttgaagacctcgggtccatgcctcccttctccgagtcgggttacggatcggtggagaagatctacgtcgtgtgcgctcaggatgagatcctcacggaaggttttcagcgctggatgatcgagaacaacccagtgaaagaggtgagagagctggaggacgctgaccatatgcccatgttctcaaccccgaagcagctgtttcagtgcctctcggatgttgccgatgcctgtgcttgatcctcccgggttttactattacaagccaccaaatactgtggccatagtaaataagatagttgttcgtgcgttgctgctgtgatcgatgcatcatggtttgctatcagcaacggtgtatttgtttcagttatcaaatcatggacagctgagaagac

SEQ ID NO: 615 - protein, 269 aa, Musa acuminata
  misc_feature (42)..(263): Pfam Name: Abhydrolase_1 Pfam Description: alpha/beta hydrolase fold
  misc_feature: Ceres Clone ID no. 1714893
  misc_feature: Bit score of 688.3 for HMM based on sequences of Figure 8
  misc_feature: Functional Homolog Of SEQ ID NO. 595
MNYGEGRGDGSCNKKHIILVHGACHGAWSWHKVTTQLRSAGYQVTVPDLAASGVDERRFQDLRSFIHYSQPLLDILACLPPGERVILVGHSLGGLNIALAMDRFPEKIAAAVFVTALMPDSVNPPSYVMDKLKKEKTMLFWSDTQFGLVGDEDKGPVSLLFGPKFLSKLYTRSPPEDLTLARTLMRPSSFFLEDLGSMPPFSESGYGSVEKIYVVCAQDEILTEGFQRWMIENNPVKEVRELEDADHMPMFSTPKQLFQCLSDVADACA

SEQ ID NO: 616 - protein, 265 aa, Vitis vinifera
  misc_feature (36)..(259): Pfam Name: Abhydrolase_1 Pfam Description: alpha/beta hydrolase fold
  misc_feature: Public GI ID no. 157329890
  misc_feature: Bit score of 755.1 for HMM based on sequences of Figure 8
  misc_feature: Functional Homolog Of SEQ ID NO. 595
MEVDRKQGRHFVLVHGACHGAWSWYKVKPRLEAAGHRVTALDMAASGINRKQIQEVHSMHEYSQPLLEMMATLPPNEKVILVGHSLGGLNLAVAMEKFPEKVSVAVFLTAFMPDTLHRPSYVLDQYVERTPNDAWLDTQFSPYGSSEKPQNSMFFGPEFISTKLYQLSPIEDLELVLALARPASLFLEDLAELKKFSNEGYGSVTSVFIRCDKDEAIRKEFQQWMIENSGGVKEVMNIKDADHMAMFSKPEELCACLLEVAHKYG

SEQ ID NO: 617 - DNA, 913 bp, Arabidopsis thaliana
  misc_feature: Ceres Annot ID no. 859635
  misc_feature: Encodes the peptide sequence at SEQ ID NO. 618
gtgtgacttttaggagagtaagaaaatatcgaaggtcagaagaatgagtgaggaaaagaggaaacaacattttgtactagtacatggttcgtgccatggcgcgtggtgctggtacaaggttaagccgctgctagaggcggtgggccaccgcgtaactgctgtggacttagctgcctccggaatagacacaacgaggtcgatcactgacatccccacatgcgaacaatactcggagccattgacgaagctcctgacctcattgccaaatgatgaaaaggttgtgctcgttggtcacagctttggtggcttgaacttagccatagccatggaaaagtttcccgaaaaaatctctgtcgctgtattcttgactgctttcatgccggacaccgaacactcaccatccttcgtcttggacaagtttggaagcaacatgcctcaagaagcatggatgggcaccgaattcgaaccttatggttcagacaattccggactgagtatgttttttagccctgacttcatgaagttgggtctctaccagctttctccagttgaggatcttgaactgggattacttttaatgaggccaggatcgttatttattaacgatttatcgaagatgaaaaacttctcggatgaaggatatgggtctgttcctcgagttttcatagtgtgtaaagaggacaaagcaattccagaagaacgccagagatggatgattgataattttccggtgaatttagtgatggagatggaggagacagatcatatgccaatgttctgcaagcctcagcaactcagtgattacttcctgaaaatcgcggacaaattcgtttaatcaaatcttcatgaaactgtattggatttgatataataaaggtttgttgcaaatgaattaataatgatgaatattttt

SEQ ID NO: 618 - protein, 263 aa, Arabidopsis thaliana
  misc_feature (35)..(257): Pfam Name: Abhydrolase_1 Pfam Description: alpha/beta hydrolase fold
  misc_feature: Ceres Annot ID no. 859635
  misc_feature: Bit score of 673.2 for HMM based on sequences of Figure 8
  misc_feature: Functional Homolog Of SEQ ID NO. 595
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPEKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 619 - protein, 263 aa, Oryza sativa subsp. japonica
  misc_feature (36)..(257): Pfam Name: Abhydrolase_1 Pfam Description: alpha/beta hydrolase fold
  misc_feature: Public GI ID no. 115440397
  misc_feature: Bit score of 481.7 for HMM based on sequences of Figure 8
  misc_feature: Functional Homolog Of SEQ ID NO. 595
MADGKVACKHLVLVHGACIGGWTYFKVATRLRSAGYRVTAPDLGASGVDPRPLREVPTFRDYTAPLLGLLGSLPPGEKVVLVGHSLGGINVALAAELFPDKIAAAVFLCAFMPDHTSRPSHVLEKFIEGKWLDWMDTEFKPQDAEGKLPTSMLFGPQIAQERLMQLCSPEDVTLAGSLLRVSSMFVEDLQKQQPFTEGRYGSVRKVYVVVNQDLAIPEGFQRWMIGNSPVDEVKEIDAADHLVMLSRPDELARCLADIAESYA

SEQ ID NO: 620 - protein, 260 aa, Nicotiana tabacum
  misc_feature (32)..(254): Pfam Name: Abhydrolase_1 Pfam Description: alpha/beta hydrolase fold
  misc_feature: Public GI ID no. 40549303
  misc_feature: Bit score of 747.1 for HMM based on sequences of Figure 8
  misc_feature: Functional Homolog Of SEQ ID NO. 595
MKEGKHFVLVHGACHGGWSWYKLKPLLEAAGHKVTALDLAASGTDLRKIEELRTLYDYTLPLMELMESLSADEKVILVGHSLGGMNLGLAMEKYPQKIYAAVFLAAFMPDSVHNSSFVLEQYNERTPAENWLDTQFLPYGSPEEPLTSMFFGPKFLAHKLYQLCSPEDLALASSLVRPSSLFMEDLSKAKYFTDERFGSVKRVYIVCTEDKGIPEEFQRWQIDNIGVTEAIEIKGADHMAMLCEPQKLCASLLEIAHKYN

SEQ ID NO: 621 - DNA, 792 bp, Populus balsamifera subsp. trichocarpa
  misc_feature: Ceres Annot ID no. 1457048
  misc_feature: Encodes the peptide sequence at SEQ ID NO. 622
atggtagagaccaagaatcagaagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaagactatggtaaggccaggatcactgtttctgtatgatttgtcaaaggcaaacagtttctccacgacgggctatgggtcagtcaaacgagtgtatgttatctgcgatgaagatttagcgataccagaagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 622 - protein, 263 aa, Populus balsamifera subsp. trichocarpa
  misc_feature (35)..(257): Pfam Name: Abhydrolase_1 Pfam Description: alpha/beta hydrolase fold
  misc_feature: Ceres Annot ID no. 1457048
  misc_feature: Bit score of 751.8 for HMM based on sequences of Figure 8
  misc_feature: Functional Homolog Of SEQ ID NO. 595
MVETKNQKHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTMVRPGSLFLYDLSKANSFSTTGYGSVKRVYVICDEDLAIPEEFQRWMIENSAVEEVMEIEGADHMVMFSKPQELFHCLSEIANKHA

SEQ ID NO: 623 - protein, 264 aa, Rauvolfia serpentina
  misc_feature (38)..(260): Pfam Name: Abhydrolase_1 Pfam Description: alpha/beta hydrolase fold
  misc_feature: Public GI ID no. 50401192
  misc_feature: Bit score of 698.1 for HMM based on sequences of Figure 8
  misc_feature: Functional Homolog Of SEQ ID NO. 595
MHSAANAKQQKHFVLVHGGCLGAWIWYKLKPLLESAGHKVTAVDLSAAGINPRRLDEIHTFRDYSEPLMEVMASIPPDEKVVLLGHSFGGMSLGLAMETYPEKISVAVFMSAMMPDPNHSLTYPFEKYNEKCPADMMLDSQFSTYGNPENPGMSMILGPQFMALKMFQNCSVEDLELAKMLTRPGSLFFQDLAKAKKFSTERYGSVKRAYIFCNEDKSFPVEFQKWFVESVGADKVKEIKEADHMGMLSQPREVCKCLLDISDS

SEQ ID NO: 624 - DNA, 795 bp, Populus balsamifera subsp. trichocarpa
  misc_feature: Ceres Annot ID no. 1451281
  misc_feature: Encodes the peptide sequence at SEQ ID NO. 625
atgggagaggtcaacaatcaaaaacagcattttgttttgatccatggttcagttgcaggagcttggatatggtacaaggtcaagccaaggctagaggaagctggccaccgtgtcacagctcttgacatggctgcatcaggggtgaacacacaaaaaattgaagaagttcgcacttttgatcagtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgatacggtgcaccagccatcttatatgttagaaaagtttgctgaaatcggtcccaagggagaagagtggcaagacactctgttttcattccatggaacccctgaagaaccgcatacatgtgttcacatgggatgcgagtttatgaagtgcaagccctttcatctttcctccgctgaggatctagctctgcagatgctcttaaatagaccaggatcgatgtttgtggaaagcctgtccaaggcaaagaagttcactgatgagagatatggatcagtgccgcgagtttatattgtttgtactgaggatttaatgatgcctgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 625 - protein, 264 aa, Populus balsamifera subsp. trichocarpa
  misc_feature (36)..(258): Pfam Name: Abhydrolase_1 Pfam Description: alpha/beta hydrolase fold
  misc_feature: Ceres Annot ID no. 1451281
  misc_feature: Bit score of 547.1 for HMM based on sequences of Figure 8
  misc_feature: Functional Homolog Of SEQ ID NO. 595
MGEVNNQKQHFVLIHGSVAGAWIWYKVKPRLEEAGHRVTALDMAASGVNTQKIEEVRTFDQYNEPLMEFMAKLPENEKVVLVGHSLGGLNLAFAMEKFPEKVSLAVFLTAILPDTVHQPSYMLEKFAEIGPKGEEWQDTLFSFHGTPEEPHTCVHMGCEFMKCKPFHLSSAEDLALQMLLNRPGSMFVESLSKAKKFTDERYGSVPRVYIVCTEDLMMPASFQRWMIEQNGVKEVMEIPADHMPVFSTPTELCHSILELARKHA

SEQ ID NO: 626 - DNA, 792 bp, Populus balsamifera subsp. trichocarpa
  misc_feature: Ceres Annot ID no. 1510252
  misc_feature: Encodes the peptide sequence at SEQ ID NO. 627
atggtagagaccaagaatcaggagcattttgttctagtacatggagcttgccatggggcttggtgctggcaaaagttcaaaacgctgcttgagtcagcaagtaacagggtcacggtgcttgaccttgctgcttcaggcgccaacatgaaggcaatccaagatgtagaaacacttgatgaatatacggagcctttgttagagtttctggcctcattacaaccgaaggagaaggtcattctagtagggcacagcctaggaggtttgagtttggctcttgctatggaaaagttcccagagaagattgctgttgctgttttcttatcagctttcatgccagataccacacacaagccatcatttgtcttggatcagtataacgagaggaccccggcggattcctggttggacactcaatttttaccatacagcagttctcaaagtcatctcacaacaatgtcttttggacccaaattcttatcctccaagctctatcagctaagcccacctgaggatcttgagcaagcaaaaactttggtaaggccaggatcaatgtttctggatgatttgtcaaaggcaaacagtttctccacgacgggctatgggtcagtcaaacgagtatatgttatctttgacaaagatttagcgataccagtagagtttcaacgctggatgattgaaaacagtgctgttgaagaagttatggaaattgaaggtgcagaccatatggttatgttcagcaagccacaagaactcttccattgtctctcagagatagcaaataaacatgcttaa

SEQ ID NO: 627 - protein, 263 aa, Populus balsamifera subsp. trichocarpa
  misc_feature (35)..(257): Pfam Name: Abhydrolase_1 Pfam Description: alpha/beta hydrolase fold
  misc_feature: Ceres Annot ID no. 1510252
  misc_feature: Bit score of 731.8 for HMM based on sequences of Figure 8
  misc_feature: Functional Homolog Of SEQ ID NO. 595
MVETKNQEHFVLVHGACHGAWCWQKFKTLLESASNRVTVLDLAASGANMKAIQDVETLDEYTEPLLEFLASLQPKEKVILVGHSLGGLSLALAMEKFPEKIAVAVFLSAFMPDTTHKPSFVLDQYNERTPADSWLDTQFLPYSSSQSHLTTMSFGPKFLSSKLYQLSPPEDLEQAKTLVRPGSMFLDDLSKANSFSTTGYGSVKRVYVIFDKDLAIPVEFQRWMIENSAVEEVMEIEGADHMVMFSKPQELFHCLSEIANKHA

SEQ ID NO: 628 - DNA, 1062 bp, Panicum virgatum
  misc_feature: Ceres Clone ID no. 1822691
  misc_feature: Encodes the peptide sequence at SEQ ID NO. 629
gcgccgagacgtggctgcaggcgcacgagaggtgatcgagcattcgagccgacgcgcgcgcagcaagcagcaccgtacccgagtttctcgccatgggcggcagcaagcacatcgtgctcgtccacggcgcgtgcctcggcggctggtcctggttcaaggtggccacccggctccgcgccgcggggtaccgcgtggacgcgccggacctggcggcgtcgggcgtggacccgcggccgctccgcgaggtgcccacgttccgggactacacggcgccgctgctggacctcctcgcggcgctcccggccggggaccgcgtggtgctcgtcggccacagcctcggcggcctgagcgtcgccctggccgccgagctgttcccggacaaggtcgccgccgccgtgttcctctgcgccttcatgcccgactgcgccgcgcggccgtcgcacgtgctcgagaagttcgtggaggggaagtggctggactggatggacacggagatgaagccgcaggacgcggagggcaagctccccacgtccatgatgttcgggccccggatcctgcgggagaagttctaccagctctgctcgcccgaggacatcaccctggcgtcgtccctgatgcgggtgagctcgatgttcgtggaggacctggccgcccagcagccgttcaccgcgggcgggtacggctcggtgcgcagggtgtacgtggtgtgctcggaggactacggcatcgtggaggggttccagagctggatggtggagaacaacccggtggaggaggtgagggagatcgccgccgaccacctggtgatgctctccaggcccgacgagctggcgcggtgcctcgccgacatcgccgacaagtacgcgtgatgaatgatgatgatgaggaagatcgatgctcgatagatctgccgctgcgtggatgcatggtgttctgttgtgatcagctttcttttctttcttaatcaaaaaagaaaccttggagaactcgagcctgttgtttcgaaatgagattgaagttcacggtgtggcgagcaattgaccaatcgtggatgtttattag

SEQ ID NO: 629 - protein, 258 aa, Panicum virgatum
  misc_feature (32)..(252): Pfam Name: Abhydrolase_1 Pfam Description: alpha/beta hydrolase fold
  misc_feature: Ceres Clone ID no. 1822691
  misc_feature: Bit score of 489.6 for HMM based on sequences of Figure 8
  misc_feature: Functional Homolog Of SEQ ID NO. 595
MGGSKHIVLVHGACLGGWSWFKVATRLRAAGYRVDAPDLAASGVDPRPLREVPTFRDYTAPLLDLLAALPAGDRVVLVGHSLGGLSVALAAELFPDKVAAAVFLCAFMPDCAARPSHVLEKFVEGKWLDWMDTEMKPQDAEGKLPTSMMFGPRILREKFYQLCSPEDITLASSLMRVSSMFVEDLAAQQPFTAGGYGSVRRVYVVCSEDYGIVEGFQSWMVENNPVEEVREIAADHLVMLSRPDELARCLADIADKYA

SEQ ID NO: 630 - protein, 259 aa, Rheum australe
  misc_feature (31)..(253): Pfam Name: Abhydrolase_1 Pfam Description: alpha/beta hydrolase fold
  misc_feature: Public GI ID no. 197312921
  misc_feature: Bit score of 688.8 for HMM based on sequences of Figure 8
  misc_feature: Functional Homolog Of SEQ ID NO. 595
MQSKHYMVVHGMSHGAWCWYKLKPLLESAGHRVTALDMGASGVNMRPVEELRSFRDYNAPLLSFMSSLPEDDKVVLVGHSLGGINIAFAMEEFPEKVSAAVFVAALVPDTVNKPSFFLDELFKKIGAANGWLDCQFSTFGSPDEPVTVISFGPKFLSLLYDSSPIEDYELAKMLTRPLPNYVTDLGKAEKLSDGKYGSVRRVYVICKEDKAIPDELVGQMIEWNGLKEVIELQGADHMPMLSNPQQLCDCLVQIAVENP

SEQ ID NO: 631 - DNA, 795 bp, Solanum lycopersicum
  misc_feature: Ceres Annot ID no. 8456439
  misc_feature: Encodes the peptide sequence at SEQ ID NO. 632
atggaagctaacaagaaacaaggaaaacattttgttctagtacatggtgcaggccatggagcttggtgttggtacaagctaaaaccattgctagaggctgcaggccacaaggtcactgctcttgacttagcagcctctggcattgatttgagaaaaatagagcaacttcacacacttcatgattacactttgccattattggaattaatggaatctcttccacaagaggagaaagccatattagttggacatagtcttggtggtatgaatttagcacttgctatggaaaaatacccaaaaaagatctatgctgctgttttcttggctgcttttatgcctgattctattcacatatcttcctatgttatggatcagtacaatgaacggacaccagcagagaattggttagatactcaatttttaccatatggtacccctgaagagccactcacatccatgacttttggtcccaaatttttggctgataagctttaccggttaagccctcctgaggatgttgcattaggattatcattagtgagaacaagttctctgtttctggaagatttgtcaaaggccaagtatttgacagatgaaggatatggatctgtgaagagagtttatgtagtgtgtacagaggataaaggcatatcaaaagaatttcaacaatggcaaattgataatattggtgttactgaagcaaaggaaattaaaggtgctgatcatatggcaatgctatgtatgcccaaaaaactttgtgacactctcgtggagattgcagataaatacaattga

SEQ ID NO: 632 - protein, 264 aa, Solanum lycopersicum
  misc_feature (36)..(258): Pfam Name: Abhydrolase_1 Pfam Description: alpha/beta hydrolase fold
  misc_feature: Ceres Annot ID no. 8456439
  misc_feature: Bit score of 748.2 for HMM based on sequences of Figure 8
  misc_feature: Functional Homolog Of SEQ ID NO. 595
MEANKKQGKHFVLVHGAGHGAWCWYKLKPLLEAAGHKVTALDLAASGIDLRKIEQLHTLHDYTLPLLELMESLPQEEKAILVGHSLGGMNLALAMEKYPKKIYAAVFLAAFMPDSIHISSYVMDQYNERTPAENWLDTQFLPYGTPEEPLTSMTFGPKFLADKLYRLSPPEDVALGLSLVRTSSLFLEDLSKAKYLTDEGYGSVKRVYVVCTEDKGISKEFQQWQIDNIGVTEAKEIKGADHMAMLCMPKKLCDTLVEIADKYN

SEQ ID NO: 633 - protein, 260 aa, Brassica rapa
  misc_feature (35)..(257): Pfam Name: Abhydrolase_1 Pfam Description: alpha/beta hydrolase fold
  misc_feature: Bit score of 632.2 for HMM based on sequences of Figure 8
  misc_feature: Functional Homolog Of SEQ ID NO. 595
MGEEKKQQHFVLVHGACHGAWCWYKVKPLLEASGHRVTALDLAASGIDTTRSITEISTCEQYSEPLIQLIASLPSDEKVVLVGHSFGGFSLTMAMDKFPDKISVSVFVTAFMPDTKHSPSFVVDKFKRETPPEAWLGSELKPYGSDNSGVSMSFSTEFMKHALYQLSPVEDIELGLLLKRPGSLFINDLSKVENFSDKGYGSVPRAYIVCKEDKTLTKEIQWWMIDNFPTKLVKEMEDTDHMPMFCKPQLLSDYLSEIAE

SEQ ID NO: 634 - protein, 258 aa, Arabidopsis thaliana
  misc_feature (32)..(252): Pfam Name: Abhydrolase_1 Pfam Description: alpha/beta hydrolase fold
  misc_feature: Public GI ID no. 15028131
  misc_feature: Bit score of 489.9 for HMM based on sequences of Figure 8
  misc_feature: Functional Homolog Of SEQ ID NO. 595
MERKHHFVLVHNAYHGAWIWYKLKPLLESAGHRVTAVELAASGIDPRPIQAVETVDEYSKPLIETLKSLPENEEVILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQRSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 635 - DNA, 875 bp, Arabidopsis thaliana
  misc_feature: Ceres Clone ID no. 270875
  misc_feature: Encodes the peptide sequence at SEQ ID NO. 636
acatcacataccaaaaaaaggcaaaacactcacgaaagaagaaacggagaggatgaagcattatgtgctagttcacggaggctgccacggtgcgtggtgttggtacaaggtgaagccgatgcttgaacattccggccaccgtgtcacggtttttgatcttacggcgcatggtgtgaacatgagcagagtagaagatattcagactttggaggatttcgctaagccgttgcttgaggttcttgagtcttttggctcggatgataaagtagtcctcgtcgcgcatagcctcggtggaataccggctgctcttgcagccgacatgtttcctagtaaaatctctgttgctgtcttcgttacttcttttatgcccgacacaacgaatccaccttcttacgtgttcgaaaagtttctcggaagcattacagaagaagaacgtatggacttcgagttagggagctatggaacagatgaccatccactaaagactgcttttcttggacctaactacttgaagaatatgtatctactttctcctatcgaagattatgaattggccaaaatgttgatgagagtcacaccggctattactagtaatctgacggggactaaaagcttaacggcacaaggatatggatcgattagtcgtgtgtatatcgtatgcggagaagataaaggtatacgtgtagatttccaacgatggatgattgagaactctccggttaaagaagtgatggagatcaaagatgcagatcatatgcctatgttttccaagcctcatgaactctgtgatcgtcttctaaagattgctgataaatatccctaagcaagaatatctatgacaatatcaataattttcatgggaataagtttttttg

SEQ ID NO: 636 - protein, 256 aa, Arabidopsis thaliana
  misc_feature (29)..(250): Pfam Name: Abhydrolase_1 Pfam Description: alpha/beta hydrolase fold
  misc_feature: Ceres Clone ID no. 270875
  misc_feature: Bit score of 486.5 for HMM based on sequences of Figure 8
  misc_feature: Functional Homolog Of SEQ ID NO. 595
MKHYVLVHGGCHGAWCWYKVKPMLEHSGHRVTVFDLTAHGVNMSRVEDIQTLEDFAKPLLEVLESFGSDDKVVLVAHSLGGIPAALAADMFPSKISVAVFVTSFMPDTTNPPSYVFEKFLGSITEEERMDFELGSYGTDDHPLKTAFLGPNYLKNMYLLSPIEDYELAKMLMRVTPAITSNLTGTKSLTAQGYGSISRVYIVCGEDKGIRVDFQRWMIENSPVKEVMEIKDADHMPMFSKPHELCDRLLKIADKYP

SEQ ID NO: 637 - protein, 263 aa, Arabidopsis thaliana
  misc_feature (35)..(257): Pfam Name: Abhydrolase_1 Pfam Description: alpha/beta hydrolase fold
  misc_feature: Public GI ID no. 27754457
  misc_feature: Bit score of 671.9 for HMM based on sequences of Figure 8
  misc_feature: Functional Homolog Of SEQ ID NO. 595
MSEEKRKQHFVLVHGSCHGAWCWYKVKPLLEAVGHRVTAVDLAASGIDTTRSITDIPTCEQYSEPLTKLLTSLPNDEKVVLVGHSFGGLNLAIAMEKFPKKISVAVFLTAFMPDTEHSPSFVLDKFGSNMPQEAWMGTEFEPYGSDNSGLSMFFSPDFMKLGLYQLSPVEDLELGLLLMRPGSLFINDLSKMKNFSDEGYGSVPRVFIVCKEDKAIPEERQRWMIDNFPVNLVMEMEETDHMPMFCKPQQLSDYFLKIADKFV

SEQ ID NO: 638 - protein, 258 aa, Arabidopsis thaliana
  misc_feature (32)..(252): Pfam Name: Abhydrolase_1 Pfam Description: alpha/beta hydrolase fold
  misc_feature: Public GI ID no. 16648679
  misc_feature: Bit score of 486.1 for HMM based on sequences of Figure 8
  misc_feature: Functional Homolog Of SEQ ID NO. 595
MERKHHFVLVHNAYHGAWIWYKLKPLLESAGHRVTAVELAASGIDPRPIQAVETVDEYSKPLIETLKSLQENEEGILVGFSFGGINIALAADIFPAKIKVLVFLNAFLPDTTHVPSHVLDKYMEMPGGLGDCEFSSHETRNGTMSLLKMGPKFMKARLYQNCPIEDYELAKMLHRQGSFFTEDLSKKEKFSEEGYGSVQRVYVMSSEDKAIPCDFIRWMIDNFNVSKVYEIDGGDHMVMLSKPQKLFDSLSAIATDYM

SEQ ID NO: 639 - protein, 263 aa, Arabidopsis thaliana
  misc_feature (35)..(257): Pfam Name: Abhydrolase_1 Pfam Description: alpha/beta hydrolase fold
  misc_feature: Public GI ID no. 15227863
  misc_feature: Bit score of 691.9 for HMM based on sequences of Figure 8
  misc_feature: Functional Homolog Of SEQ ID NO. 595
MSEEKRKQHFVLVHGACHGAWCWYKVKPLLEALGHRVTALDLAASGIDTTRSITDISTCEQYSEPLMQLMTSLPNDEKVVLVGHSFGGLSLALAMDKFPDKISVSVFVTAFMPDTKHSPSFVEEKFASSMTPEGWMGSELETYGSDNSGLSVFFSTDFMKHRLYQLSPVEDLELGLLLKRPSSLFINELSKMENFSEKGYGSVPRAYIVCKEDNIISEDHQRWMIHNYPANLVIEMEETDHMPMFCKPQLLSDHLLAIADNFC

SEQ ID NO: 640 - DNA, 795 bp, Populus balsamifera subsp. trichocarpa
  misc_feature: Ceres Annot ID no. 1451282
  misc_feature: Encodes the peptide sequence at SEQ ID NO. 641
atgggagaggtcaacaatcaaaaaaagcattttgttttgatccatggttcagttgcaggagcttggatatggtacaaggtcaagccaaggctagaggaagctggccaccgagtcacagctcttgacatggctgcatcaggggtgaacacaaaaacaattgaagaagttcgcactttcgatctgtataatgagcccttgatggagttcatggccaaattacctgaaaatgaaaaggttgtattggtggggcacagtttaggtggcttgaatctggcttttgctatggagaaattcccagagaaggtttctcttgctgtttttcttactgcaatcttgcctgataccgtgcaccagccatcttatatgttagaaaagtttgctgaaatcggtcccagggacgaagaatggcaagacactctgttttcattccatggaacccctgaagaaccgcatacatgtgttcatatgggttgcgagtttatgaagtgcaagccctttcatctttcctccgctgaggatctcgctctgcagatgctcttaaatagaccaggatcgatgtttgtggaaagcctgtccaaggcaaagaagttcactgatgagagatatggatcagtgccgcgagtttatattgtttgtactgaggatttaatgatgcttgcctcatttcagcgctggatgattgagcaaaatggggtaaaggaagtgatggagattcctgcagatcatatgccagttttttctacgcctacagaactctgccattctatactggagttggcacgcaagcatgcttag

SEQ ID NO: 641 - protein, 264 aa, Populus balsamifera subsp. trichocarpa
  misc_feature (36)..(258): Pfam Name: Abhydrolase_1 Pfam Description: alpha/beta hydrolase fold
  misc_feature: Ceres Annot ID no. 1451282
  misc_feature: Bit score of 540.7 for HMM based on sequences of Figure 8
  misc_feature: Functional Homolog Of SEQ ID NO. 595
MGEVNNQKKHFVLIHGSVAGAWIWYKVKPRLEEAGHRVTALDMAASGVNTKTIEEVRTFDLYNEPLMEFMAKLPENEKVVLVGHSLGGLNLAFAMEKFPEKVSLAVFLTAILPDTVHQPSYMLEKFAEIGPRDEEWQDTLFSFHGTPEEPHTCVHMGCEFMKCKPFHLSSAEDLALQMLLNRPGSMFVESLSKAKKFTDERYGSVPRVYIVCTEDLMMLASFQRWMIEQNGVKEVMEIPADHMPVFSTPTELCHSILELARKHA

SEQ ID NO: 642 - protein, 258 aa, Catharanthus roseus
  misc_feature (32)..(252): Pfam Name: Abhydrolase_1 Pfam Description: alpha/beta hydrolase fold
  misc_feature: Public GI ID no. 53830670
  misc_feature: Bit score of 723.2 for HMM based on sequences of Figure 8
  misc_feature: Functional Homolog Of SEQ ID NO. 595
MEVMKHFVTVHGVGHGAWVYYKLKPRIEAAGHRCTAVNLAASGINEKKLEEVRSSIDYAAPLLEVLDSVPENEKVILVGHSGGGMTAAVGMEKFPNKISLAVFLNAIMPDTENRPSYVLEEYTAKTPPEAWKDCQFSAYGDPPITSLVCGPEFISSTLYHLSPIEDHALGKILVRPGSLFIEDLLKAEKFTEEGFGSVPRVYVIAAEDKTIPPEFQRWMIENNPVKEVKEIKGADHMPMFSKPDELSQCLLDIAKKHA

SEQ ID NO: 643 - protein, 259 aa, Gentiana triflora var. japonica
  misc_feature (32)..(253): Pfam Name: Abhydrolase_1 Pfam Description: alpha/beta hydrolase fold
  misc_feature: Public GI ID no. 146272405
  misc_feature: Bit score of 682.5 for HMM based on sequences of Figure 8
  misc_feature: Functional Homolog Of SEQ ID NO. 595
MSPTKHFVAVHGVGHGAWVYYKLKPRIEAAGLKFTAIDLAAAGVNPKKLEEVNSLEEYCAPLFDVLAAVPEGEKVILVGHSGGGLSAAVGMEKFPKKISVAVFLNAIMPDTKNRPSYVMEEYTARTPIEAWKDTQFSAYGEPPITALLCGPEFISTSLYHLSPVEDHTLGKLLVRPGALFVEDLLKGAVKFTDEGFGSVPRVYVVATEDKTIPPEFQRWMIENNPVAEVKEIQGADHLPQFSKPDELTQVLVDIAKNHG

SEQ ID NO: 644 - DNA, 1739 bp, Glycine max
  misc_feature: Ceres Clone ID no. 625057
  misc_feature: Encodes the peptide sequence at SEQ ID NO. 645
ctattcttacacggcatggatctcgtggccactctgttttagtttaatcagaagcaaaatccacaaaactaacagtgtattaaaatttctgaacctgaaaaattgttattattttgatagggtttataggaaaagcagcatacccgagttcacaaacactgaacgccgctgctccgtagtttcgatcgacgcattcttcacttcaagatatcacaatgtctataacgcacagcctcactactccactctcttcttcttcctctgctttcttagctccttcttccttcaattgcaggggacaggtttcgttgcctgtgaagagcgtgagcatttgcaaatgcgttgccacacccgaagctgagactgcctacaagacaggggtcaatcgcaatccaaatatggggaaacttcaagctggctatctctttcccgagattgctagaagaaggtctgcgcacttgctgaagtaccctgatgctaaagtaataagccttggaattggtgatacaactgaacctattcctgaagtcataactgatgcaatgtcaaagagatcacatgcattgtcgactatagaaggatacagtgggtatggagctgaacaaggtgaaaagccattaagaagggcacttgcttcaacattttacagcgatcttggcatagaagaggatgatatatttgtctcagatggagcaaagtgtgatatatctcgtctccagattgtctttgggtcaaatgtaaaaatggctgtgcaagacccttcatatccggcctatgtagactctagtgtaattatgggccagactggcctcttccagaagaatgttgagaagtttgcaaacattgaatacatgaggtgtaatccggaaaatggtttcttccctgatttgtcttcaatttctcgaccagatataatatttttctgttctccaaacaatcctactggtgctgtggcaacaagggaacaactgacccaactagttcagtttgctaaggacaatggttctatagtaatccacgattcagcttatgcaatgtatatttctggtgacaaccctcgctcaatatttgaaattcctggagccaaagaggttgccattgagacttcatcatttagcaagtatgctgggttcactggagtccgattgggttggactgtggttccgaagcagttgctgttttctgatggatttcctgttgccaaggacttcaaccgtattgtatgcacttgtttcaatggtgcttcaaatatttcccaggcaggcggtctggcttgcctttcaccagaaggtcttaaggctatgcgtgatgttattggattctacaaggaaaatactaacataataatggagacatttgattctcttgggtttaaagtctatggagggaaagatgcaccatatgtgtgggtccattttcccggccgaagctcatgggatgtattcgctgagattcttgagaagactcatgtggttacaacccctggtagtggttttggacctggtggtgaaggttttatcagggttagtgcctttggtcacagggaaaatgtcttggaggcatgcagaaggttcaagcagctatacaagtgaagttagaatatctcatttggtttcaagagttgttctcttggactgaagctagggctgtcttatttaaataatgcaattgattttccgtggagtttagattataagatgtaaagacagggtttatcaattgaggaagtatatttttct

SEQ ID NO: 645 - protein, 458 aa, Glycine max
  misc_feature (88)..(453): Pfam Name: Aminotran_1_2 Pfam Description: Aminotransferase class I and II
  misc_feature: Ceres Clone ID no. 625057
  misc_feature: Bit score of 1204.2 for HMM based on sequences of Figure 5
MSITHSLTTPLSSSSSAFLAPSSFNCRGQVSLPVKSVSICKCVATPEAETAYKTGVNRNPNMGKLQAGYLFPEIARRRSAHLLKYPDAKVISLGIGDTTEPIPEVITDAMSKRSHALSTIEGYSGYGAEQGEKPLRRALASTFYSDLGIEEDDIFVSDGAKCDISRLQIVFGSNVKMAVQDPSYPAYVDSSVIMGQTGLFQKNVEKFANIEYMRCNPENGFFPDLSSISRPDIIFFCSPNNPTGAVATREQLTQLVQFAKDNGSIVIHDSAYAMYISGDNPRSIFEIPGAKEVAIETSSFSKYAGFTGVRLGWTVVPKQLLFSDGFPVAKDFNRIVCTCFNGASNISQAGGLACLSPEGLKAMRDVIGFYKENTNIIMETFDSLGFKVYGGKDAPYVWVHFPGRSSWDVFAEILEKTHVVTTPGSGFGPGGEGFIRVSAFGHRENVLEACRRFKQLYK

SEQ ID NO: 646 - DNA, 1701 bp, Gossypium hirsutum
  misc_feature: Ceres Clone ID no. 1925947
  misc_feature: Encodes the peptide sequence at SEQ ID NO. 647
aaggcatcacatttgtggttatttggccgcataaaaaagaagcagctttttccattaatttcggagggaaaaaaaaggggaaaaaaaatctgaaaatgtctctgatgaacaatctatcaacttcaatgatttcttcatcttcatctactttcttggctccaaccagtttcaattcaagcagaacccagagtgtttcagttccattgaaaagcatcaatatagttaaatgtgttgccactcctcaagaacaacaaaatgcttacaaaactaaagtttctcgcaatgcgaacatagctaagcttcaagctggttacctgtttccagaggttgccaggagaagggctgcacacttgctcaagtacccgaatgctcaagtgataagccttggaatcggtgatactactgaacctattccagatgttattacgtctgcaatggctaagaggtctcatgcattgtctacgctggagggttacagtggttatggagctgaacaaggtgaaaaggcattgagagctgcacttgcttcaacattctatcgcaaccttggcattgaggatgatgatatttttgtctcagatggtgctaaatgtgacatatctcgccttcaggttgttttcggatctaatgtcacaatggcagtgcaagacccgtcatacccggcttacgtagattccagcgttatcatgggtcagaccggacagtttcaaaaggatgttgagaagtatggaaatatcgagtatatgaggtgtacacccgagaatggattctttcctgatttatccaaagttgctagaactgatatcatattcttctgttcaccaaacaatcctactggtgctgctgcaacacgagagcaattgactcgattggttaagtttgcaaaggacaatgggtctatcatagtctatgattctgcatatgctatgtatatgtcagacgataaccctcgttctatctttgaaattccaggagcaaaagaggttgcaattgaaacagcttcttttagtaagtatgctgggtttactggggttcgtctcggttggactgttattccaaaacagcttctgttctcagatggattccctgttgccaaagacttcaaccgtatcgtttgtacttgctttaacggtgcatctaatattgcccaagctggtggcttggcttgcctttcatccgaagggctcgaggccatgcaagaggtgatcggcttctataaagaaaacaccaaaattatagtagaaacgttcaactcgcttgggtttaaagtatatggaggaaagaatgcaccatacgtgtgggttcacttccctggccgtagctcatgggatgtgttcagcgaaatactcgagaagacccacattgttactacgcctggaagtggtttcggacctggcggtgaaggtttcatcagagtcagcgcatttggtcacagggagaatgtcttggaagcttgcagaagattcaagcagctttacaattgaatctaatagcatttgactggttacctcggtttcagacccgagacgaaaggccgtatgcttctatgatttttgttctcaattccgtaatattgcttgtaatatctcgtcagattctatgcttagaaaagactagtaatgcttcttatttatcctgtaacattcactgaaaactacctttttatttatataaataaccgcttgtattcgccaagcaaat

SEQ ID NO: 647 - protein, 462 aa, Gossypium hirsutum
  misc_feature (92)..(457): Pfam Name: Aminotran_1_2 Pfam Description: Aminotransferase class I and II
  misc_feature: Ceres Clone ID no. 1925947
  misc_feature: Bit score of 1229.4 for HMM based on sequences of Figure 5
  misc_feature: Functional Homolog Of SEQ ID NO. 645
MSLMNNLSTSMISSSSSTFLAPTSFNSSRTQSVSVPLKSINIVKCVATPQEQQNAYKTKVSRNANIAKLQAGYLFPEVARRRAAHLLKYPNAQVISLGIGDTTEPIPDVITSAMAKRSHALSTLEGYSGYGAEQGEKALRAALASTFYRNLGIEDDDIFVSDGAKCDISRLQVVFGSNVTMAVQDPSYPAYVDSSVIMGQTGQFQKDVEKYGNIEYMRCTPENGFFPDLSKVARTDIIFFCSPNNPTGAAATREQLTRLVKFAKDNGSIIVYDSAYAMYMSDDNPRSIFEIPGAKEVAIETASFSKYAGFTGVRLGWTVIPKQLLFSDGFPVAKDFNRIVCTCFNGASNIAQAGGLACLSSEGLEAMQEVIGFYKENTKIIVETFNSLGFKVYGGKNAPYVWVHFPGRSSWDVFSEILEKTHIVTTPGSGFGPGGEGFIRVSAFGHRENVLEACRRFKQLYN

SEQ ID NO: 648 - DNA, 1386 bp, Populus balsamifera subsp. trichocarpa
  misc_feature: Ceres Annot ID no. 1514501
  misc_feature: Encodes the peptide sequence at SEQ ID NO. 649
atgtcgccgacgcaacttttatcgacttcgatttcttcttcttcctctgcttttttagccgcacctattgccttcaaagctagaaaccagaatgtttcgatcgcgtcgaaaacgccttctatttgcacgtgtgctgctgctcctcaagaacagaaaaccgtttacaaaacacaagtctcccgcaatgcaaatattgcaaagcttcaagctggttacttatttccagaggttgctcgaaggaggaatgcgcacatgctgaaataccctgatgcaaaagtgataagccttggaattggtgacactacagaacctatcccagaagttataacttctgcaatagcaaagagagcagaagcactgtctactttggagggttacagtggttatggacctgaacaaggtgaaaaacctttgagaactgcaattgcttcaacattttattcaggtcttgggatcgaggaggatgatatatttgtctctgatggtgccaaatgtgacatatctcgcctccagatggtatttggggcaaatgtaaccatggcagtgcaagatccatcatacccggcttacgttgattctagtgtcatcatgggccagactggacagtttcagaaagacgttgagaagtacggtaagattgaatacatgaggtgcactccagagaatggttttttccctgatttatccaaagtttctcgaacggatatcatatttttctgttcaccgaacaatcctactggttctgctgcaacaagggagcaactgacccaactagtacaatttgcaaaggacaatggatcaatcatcgtctatgattcagcatatgccatgtatatgtctgatgataacccacgatccatatttgaaattccgggagccaaagaggttgctttggagacatcatcttttagtaagtatgctgggtttactggagttcgtctggggtggactgttgttccaaaacagcttctatattctgatgggttcccagttgtaaaggatttcaaccgtgttgtttgcactagctttaatggggcatccaacatttgccaagctggtggtcgggcttgcctttcacctgaaggccttaaggcaatgagtgaggtgattggattctataaagaaaactccaacattataatggatacattcaattcgctcggttttaatgtatatggaggaaagaatgctccctatgtgtgggttcacttccctggccaaagctcgtgggatgttttcagtgaaattcttgagaaaactcatgtagttaccacacctgggagtggttttggacctggtggggaaggttttgtcagagtcagtgcttttggccacagggaaaatgttttagaagcctgcagaagattcaagcagctttacaattga

SEQ ID NO: 649 - protein, 461 aa, Populus balsamifera subsp. trichocarpa
  misc_feature (91)..(456): Pfam Name: Aminotran_1_2 Pfam Description: Aminotransferase class I and II
  misc_feature: Ceres Annot ID no. 1514501
  misc_feature: Bit score of 1200.7 for HMM based on sequences of Figure 5
  misc_feature: Functional Homolog Of SEQ ID NO. 645
MSPTQLLSTSISSSSSAFLAAPIAFKARNQNVSIASKTPSICTCAAAPQEQKTVYKTQVSRNANIAKLQAGYLFPEVARRRNAHMLKYPDAKVISLGIGDTTEPIPEVITSAIAKRAEALSTLEGYSGYGPEQGEKPLRTAIASTFYSGLGIEEDDIFVSDGAKCDISRLQMVFGANVTMAVQDPSYPAYVDSSVIMGQTGQFQKDVEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEGFVRVSAFGHRENVLEACRRFKQLYN

SEQ ID NO: 650 - DNA, 1386 bp, Arabidopsis thaliana
  misc_feature: Ceres Annot ID no. 849672
  misc_feature: Encodes the peptide sequence at SEQ ID NO. 651
atgtcgtcgacccatcagttagtttcttcgatgatctcttcttcctcatccactttcttagccccttcaaattttaatctcagaactcgaaatgcttgcttacccatggcaaaacgggtcaatacttgcaaatgtgttgctacgccgcaagagaagatcgagtataagaccaaagtgtcacggaattcaaacatgtccaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaggtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcaggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgggtttggaccagggggtgaagggttcgttcgtgtcagtgcctttggtcacagagagaacatcttagaggcatgtcgaagattcaagcagctttacaaatga

SEQ ID NO: 651 - protein, 461 aa, Arabidopsis thaliana [sequence omitted]

SEQ ID NO: 652 - protein, 459 aa, Vitis vinifera
  misc_feature (89)..(454): Pfam Name: Aminotran_1_2 Pfam Description: Aminotransferase class I and II
  misc_feature: Public GI ID no. 157355942
  misc_feature: Bit score of 1189.7 for HMM based on sequences of Figure 5
  misc_feature: Functional Homolog Of SEQ ID NO. 645
MYSLMSSPSISSSSSSFLGQTHFDSRNPNACLPTKDSWICKCVATPSTETTAHTTKVSRNANMAKLQAGYLFPEIARRRSAHMLKYPDAQVISLGIGDTTEPIPEVITSGMAKKAHALSTLEGYSGYGAEQGEKQLRAAIASTFYGDLSIEESDIFVSDGAKSDISRLQVMFGSNVTMAVQDPSYPAYVDLSVILGQTGQFQKDVEKYGNIEYMKCNPENGFFPDLSTVSRTDIIFFCSPYNPTGNAATREQLTRLVQFAKDNGSILVYDSGYAMYISDDSPRSIFEIPGAKEVAIEVSSFSKYAGFTGVRLGWTVVPKELLYSDGFPVAKDFNRIECTTFNAASNISQASGLACLSPEGLEAMHKLVGFYKENTNIIMETFTSLGFSVYGGKNAPYVWVHFPGQSSWDVFSEILEKTHVVTTPGSGFGPAGDGFIRVCAFSHRGNVLEACKRFKRLYK

SEQ ID NO: 653 - protein, 464 aa, Oryza sativa subsp. japonica
  misc_feature (94)..(459): Pfam Name: Aminotran_1_2 Pfam Description: Aminotransferase class I and II
  misc_feature: Public GI ID no. 115452503
  misc_feature: Bit score of 1198.1 for HMM based on sequences of Figure 5
  misc_feature: Functional Homolog Of SEQ ID NO. 645
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 654 - DNA, 1695 bp, Panicum virgatum
  misc_feature: Ceres Clone ID no. 1790933
  misc_feature: Encodes the peptide sequence at SEQ ID NO. 655
acccgcactgcacactccccttaccctttcctacgccgccgcctcttctgctgacgccatggccgccgcccccgcctcttctgccgccgctatggccgcggcacccgcaatcaccgcgtcctcctcctttgtctcgtcgtcgccgtgctctctcagggtgtcgaagacaagcccccggcgacccacgggaagagtgtcccacaaaatcagctgcgtcagtagcccaccggccgccgaaacatcttacaagactagtgtcccgcgcaatgctaacatggccaagctccaagcaggatatttatttcctgagattgccaggagaagagcagctcatttgctcaagttccctgatgctaagattataagccttgggataggtgacactacggagcccattccagatgtcataacgaatgccatggcagagagagcacatgccttatcaacaattgatggctacagtggttatggagctgagcaaggtgaaaagaaactaaggtcagcaattgctgcaacctactatgtggaccttggtattgaagattcagacatatttgtctctgatggtgccaaatgtgacatttcccgcctgcaggttctttttggatctaatgtgacgattgcggtccaagacccatcataccctgcatatgttgattcaagtgttatcatgagccaaactggcttatatcagcaagatgttcagaagtacgggaacatcgagtacatgagatgcaatcctgaaaatggatttttccctgatctgtcaactgtcccacgtacagatataattttcttttgctcaccgaacaaccccactggtgctgctgcctctcgggaccaactgacgagactagtcaaatttgctaaggacaatgggtctatcattgtctatgattctgcctatgctatgtacatatcagatgatagcccaaagtctatctttgaaattcctggtgcgagagaggttgccattgagacagcatcattctcgaaatatgctgggttcactggtgtccgtctaggttggactgttgtccccaaggagcttcttttctcagatgggcatccagtcgctaaagatttcaaccgcattgtgtgcacctgcttcaatggcgcatcaaacattgctcaagctggtggcttagcttgcctctctccagagggtctgaaggctatgcatgatgttgttggcttctacaaggagaatactgaaataattgtcgacacgtttacatcgcttggattcaatgtatatggtgccaagaacgctccttatgtgtgggtgcacttccctggtcgcaattcgtgggatgtgttcgctgagatccttgagaaggcgaacgttgtcactacgcctggcagtggatttggacctggcggcgaaggctttgtgagggtcagcgcgtttggccacagagaaaacatcattgaagccgctaggagattaaaacagctgtacaagtgagcactgacgcagcttcagtaacgtcttggaaggacgatatcaataagattgcatcatgatttggaacaccaaattcgctctgtcgagctacttggagatattagaagcgaaacttgataatttcctaggcttttatgttgtggtagttctttcaaataatttccaattcgaaagatgcttgttgtatccccgagacatttgaatcaccaggtagtggttatatggcc

SEQ ID NO: 655 - protein, 469 aa, Panicum virgatum
  misc_feature (99)..(464): Pfam Name: Aminotran_1_2 Pfam Description: Aminotransferase class I and II
  misc_feature: Ceres Clone ID no. 1790933
  misc_feature: Bit score of 1198.3 for HMM based on sequences of Figure 5
  misc_feature: Functional Homolog Of SEQ ID NO. 645
MAAAPASSAAAMAAAPAITASSSFVSSSPCSLRVSKTSPRRPTGRVSHKISCVSSPPAAETSYKTSVPRNANMAKLQAGYLFPEIARRRAAHLLKFPDAKIISLGIGDTTEPIPDVITNAMAERAHALSTIDGYSGYGAEQGEKKLRSAIAATYYVDLGIEDSDIFVSDGAKCDISRLQVLFGSNVTIAVQDPSYPAYVDSSVIMSQTGLYQQDVQKYGNIEYMRCNPENGFFPDLSTVPRTDIIFFCSPNNPTGAAASRDQLTRLVKFAKDNGSIIVYDSAYAMYISDDSPKSIFEIPGAREVAIETASFSKYAGFTGVRLGWTVVPKELLFSDGHPVAKDFNRIVCTCFNGASNIAQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRENIIEAARRLKQLYK

SEQ ID NO: 656 - DNA, 1389 bp, Sorghum bicolor
  misc_feature: Ceres Annot ID no. 8641620
  misc_feature: Encodes the peptide sequence at SEQ ID NO. 657
atggcagcagcccctgccggtgcccccgcaatcaccgcctcatcctcctttcttgcttcgccgccgttcgctctcaaggcatcgacgactagccaccgccgacctgcggggagagtctccgtcaacatccgctgcgtcagtagcccgccggccgtcgacacatcttacaagactaatgtcccgcgcaatgctaacatggccaagctccaagcaggatatctgtttcctgagattgccaggagaagagcagctcatttgctgaagtatccagatgccaagataataagccttgggataggtgacactaccgagcccattccaaatgtcataacaaatgccatggcagagagagcacttgccttgtcaacaattgatggctacagcggttatggagccgagcaaggtgaaaagaaactcagagcagcaattgctgcaacctactatgcggaccttggtattgaagattcagatatttttgtctctgatggtgccaagtgtgacatatctcgcttgcaggtcctttttggatctaatgtgacaattgcggtccaagatccctcataccctgcatatgttgattcaagtgttatcatgggccaaactgacttatatcagcaagatgttcagaagtacggaaacattcaatacatgagatgcagtccagaaaatggatttttccctgatctgtcaactatccctcggacagatattattttcttttgttcacccaacaatcctactggtgctgctgcatctcgggaccaactgaccaaattagtaaaatttgcaaaggacaatgggtccatcattgtctatgattctgcttatgcaatgtacatatcagatgacagcccaaagtctatctttgaaattcctggagcaaaggaggttgctcttgagacagcgtcattctcgaaatatgctgggttcactggtgtccgtctaggttggactgttgtccccaaggagctccttttctctgatggacatccagttgctaaagatttcaatcgcatagtctgcacttgcttcaatggtgcatcaaacatttcacaagctggtggtttagcttgcctctctccagagggtctgaaggctatgcatgatgttgttggcttctacaaggagaacactgaaataattgttgacacatttacatcacttggattcaacgtgtatggtgcgaagaacgctccttacgtatgggtgcacttccctggccgcaattcgtgggacgtgtttgctgagatcctggagaaggcgaatgtggttactactcctggcagtggatttggaccgggtggcgaaggctttgtgagggtcagcgcattcggacacagagataacatcattgaagctgcaaggagattaaagcagctgtacaagtga

SEQ ID NO: 657 - protein, 462 aa, Sorghum bicolor
  misc_feature (92)..(457): Pfam Name: Aminotran_1_2 Pfam Description: Aminotransferase class I and II
  misc_feature: Ceres Annot ID no. 8641620
  misc_feature: Bit score of 1203.6 for HMM based on sequences of Figure 5
  misc_feature: Functional Homolog Of SEQ ID NO. 645
MAAAPAGAPAITASSSFLASPPFALKASTTSHRRPAGRVSVNIRCVSSPPAVDTSYKTNVPRNANMAKLQAGYLFPEIARRRAAHLLKYPDAKIISLGIGDTTEPIPNVITNAMAERALALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIQYMRCSPENGFFPDLSTIPRTDIIFFCSPNNPTGAAASRDQLTKLVKFAKDNGSIIVYDSAYAMYISDDSPKSIFEIPGAKEVALETASFSKYAGFTGVRLGWTVVPKELLFSDGHPVAKDFNRIVCTCFNGASNISQAGGLACLSPEGLKAMHDVVGFYKENTEIIVDTFTSLGFNVYGAKNAPYVWVHFPGRNSWDVFAEILEKANVVTTPGSGFGPGGEGFVRVSAFGHRDNIIEAARRLKQLYK

SEQ ID NO: 658 - DNA, 1718 bp, Zea mays
  misc_feature: Ceres Clone ID no. 281497
  misc_feature: Encodes the peptide sequence at SEQ ID NO. 659
aaaaaaactcacatcgttccctacaccctactccctccgtcagccagcgaagttccttcagtcactcaacaccttacgtccctagccatcctccgccgcctccgtctctgcttccctagagccgtcgcgatggcagcagcccctgccggtgcccctgcaatcaccgcatcctcctcctttgtttcttcgtctccgttctgtctcaaggcatcgatgaccagccagcgccgacccgcggggagagtctccatcgtcatccgctgcgtcagtagcccgccggccgtcgacacatctttcaagactaatgtcccgcgcaatgctaatatggccaaactccaagcaggatatttgtttcctgagattgccaggagaagagccgctcatttgctgaagtttccagatgccaaaattataagccttggaataggcgacactaccgagcccattccaaatgtcataacaaatgccatggcagagagagcacatgccttgtcaacaattgatggctacagcggttatggagctgagcaaggtgaaaagaaactcagagcagcaattgctgcaacctactatgcggaccttggtattgaagattcagacatatttgtctctgatggtgccaaatgtgacatatctcgcttgcaggtcctttttggatctaatgtgacaattgcggtccaagatccatcataccctgcatatgttgattcaagtgttatcatggggcaaactgatttatatcagcaagacgttcagaagtatggaaacattgagtacatgagatgcggtccagaaaatggattttttcctgatctgtcaactgtccctaggacagatattattttcttttgttcacccaacaatcctactggtgctgctgcatctcgggaccaactaaccaaattagtaaaatttgcaaaggacaacgggtccatcatagtctatgattctgcttatgcaatgtacatatcagatgacagcccaaagtctatctttgaaattcctggagcaaaggaggttgctattgagacagcctcattctcgaaatacgctgggttcacaggtgtccgtmtaggttggactgttgtccccaaggagctccttttctcggatggacatccagttgctaaagatttcaatcgcatagtttgcacttgcttcaatggtgcatcaaacattgcgcaagctggtggtttagcctgcctctctccagacggtctaaaggctatgcaagatgttgttggcttctacaaggagaacactgaaataatsgttgagacatktacatcactcggattcaacgtgtatggcgccaagaacgctccatacgtatgggtgcacttccctggccgcaattcgtgggatgtgttcgctgagatcctggagaaggccaatgtggtcactactcctggcactggatttggaccgggtggcgaaggctttgtgagggtcagcgcgttcgggcacagagagaacatcattgaagccgcaaggaggtyaaagcagctgtataagtgagcaccgatgcagcttctgtgccctcctagacagatgtatcaataagaacacatcagggcaccaaaaatcgcttggtgaagctgccagaagatgttagattttgaacttttttttttaattctcgtgcggtgtctacattcraaccatttcgaactctagacaatgcttgttgtaatcctgagacccttcattcactggtg

SEQ ID NO: 659 - protein, 462 aa, Zea mays
  misc_feature (92)..(457): Pfam Name: Aminotran_1_2 Pfam Description: Aminotransferase class I and II
  misc_feature: Ceres Clone ID no. 281497
  misc_feature: Bit score of 1192.4 for HMM based on sequences of Figure 5
  misc_feature: Functional Homolog Of SEQ ID NO. 645
  misc_feature (315)..(315): Xaa is any aa, unknown, or other
  misc_feature (381)..(381): Xaa is any aa, unknown, or other
  misc_feature (385)..(385): Xaa is any aa, unknown, or other
  misc_feature (457)..(457): Xaa is any aa, unknown, or other
MAAAPAGAPAITASSSFVSSSPFCLKASMTSQRRPAGRVSIVIRCVSSPPAVDTSFKTNVPRNANMAKLQAGYLFPEIARRRAAHLLKFPDAKIISLGIGDTTEPIPNVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCGPENGFFPDLSTVPRTDIIFFCSPNNPTGAAASRDQLTKLVKFAKDNGSIIVYDSAYAMYISDDSPKSIFEIPGAKEVAIETASFSKYAGFTGVRXGWTVVPKELLFSDGHPVAKDFNRIVCTCFNGASNIAQAGGLACLSPDGLKAMQDVVGFYKENTEIXVETXTSLGFNVYGAKNAPYVWVHFPGRNSWDVFAEILEKANVVTTPGTGFGPGGEGFVRVSAFGHRENIIEAARRXKQLYK

SEQ ID NO: 660 - protein, 465 aa, Physcomitrella patens subsp. patens
  misc_feature (92)..(457): Pfam Name: Aminotran_1_2 Pfam Description: Aminotransferase class I and II
  misc_feature: Public GI ID no. 168013851
  misc_feature: Bit score of 1134.3 for HMM based on sequences of Figure 5
  misc_feature: Functional Homolog Of SEQ ID NO. 645
MSIPSARLCTVPATRNLSSSVSFSTATSLLPKVSVTRGASVSLIRCIAEPAEKTTYTTSVNRNANIAKLQAGYLFPEIARRRNAHIQRYPDAKVISLGIGDTTEPIPTVITGAMEARARALSTLEGYSGYGAEQGEKPLRAGIGAAFYADLGIDETEIFVSDGAKCDITRLQLVFGPNVTMAAQDPSYPAYVDTSVMMGQTGLFQSDSQQYSKIQYMKCTPENDFFPDLSSTPRTDIIFFCSPNNPTGASASRKQLEELVAFAKKNGSIIVYDSAYAIYTSDDSPKSIYEIPGAKECAIETASFSKYAGFTGVRLGWTVVPKALKFADGHPVHTDFNRVMTTCFNGASNVAQAGGLACVSSEGLKAMHETVKFYKENTKILVETFESLGFKTFGGKNAPYVWVQFPGKSSWDVFSEILEQTHIVTTPGSGFGPGGEGFIRASAFGHRENILEASRRLKEYFGSKK

SEQ ID NO: 661 - DNA, 1503 bp, Arabidopsis thaliana
  misc_feature: Ceres Clone ID no. 143214
  misc_feature: Encodes the peptide sequence at SEQ ID NO. 662
attttgctctgcaaatttgtctgaaaaaatctttgtgcgaagcaggaaaaatgtcgtcgacccatcagttagtttcttcgatgatctcttcttcctcatccactttcttagccccttcaaattttaatctcagaactcgaaatgcttgcttacccatggcaaaacgggtcaatacttgcaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaagtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcaggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgagtttggaccagggggtgaagggttcgttcgtgtcagtgcctttggtcacagagagaacatcttagaggcatgtcgaagattcaagcagctttacaaatgaagaaccttgtttgtaatcgttcctcatcatcatcaccctctttaatgacatgatttgagttaaaataatgtcgtttccattgttttctggaatttgtagaagacacttttgacaccagtgtttcaagcaatttggc

SEQ ID NO: 662 - protein, 438 aa, Arabidopsis thaliana
  misc_feature (68)..(433): Pfam Name: Aminotran_1_2 Pfam Description: Aminotransferase class I and II
  misc_feature: Ceres Clone ID no. 143214
  misc_feature: Bit score of 1113.6 for HMM based on sequences of Figure 5
  misc_feature: Functional Homolog Of SEQ ID NO. 645
MSSTHQLVSSMISSSSSTFLAPSNFNLRTRNACLPMAKRVNTCKLQAGYLFPEIARRRSAHLLKYPDAQVISLGIGDTTEPIPEVITSAMAKKAHELSTIEGYSGYGAEQSAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSEFGPGGEGFVRVSAFGHRENILEACRRFKQLYK

SEQ ID NO: 663 - DNA, 1678 bp, Panicum virgatum
  misc_feature: Ceres Clone ID no. 1781022
  misc_feature: Encodes the peptide sequence at SEQ ID NO. 664
gtcccccgtgacagcgaagcagaggctcatcaccctacccaagtacccatcctccgccgccgccatggcagcagcccccaccggcggccccgccatcaccatgtcctcctcctccttcctctctccgtcgccgttctatgtcaaggcgtcgaggaccagccaccgccgacccgccaggagaatgcctgtcaccgtccgctgcgtcagtagcccgccggccgccgatacagctcacaagactagtgtcccgcgcaatgcaaacatgaccaagctccaagcaggatatctgtttcctgagatagccaggagaagagcagctcatttgctgaagtaccctgatgctgagattataagccttgggataggtgacactaccgagcccattcctgacgtcataacaaatgccatggcagagagagcacatgccttatcaacaattgatggctacagtggttatggagctgagcaaggtgaaaagaaactaagggcagcaattgctgcaacctactatgcggaccttggtattgaagattcagacatatttgtctctgatggtgccaaatgtgacatttctcgcctccaggtcctttttggatctaatgtgacaattgcggtccaagacccatcataccctgcatatgttgattcaagtgttatcatgggccaaaccgacttatatcagcaagatgttcagaagtatgggaacattgagtacatgagatgcaatcccgaaaatggatttttccctgatctgtcaactgtcccacgaacagatataattttcttttgttcacccaacaaccctactggtgctgctgcatctcgggaccaactaacaaaactagtcaaatttgctaaggacaatgggtccatcattgtctatgattctgcttatgctatgtacatatcagatgatagtccaaagtccatctttgaaattcctggagcaaaagaggttgccattgagacagcatcattctcaaaatatgctgggttcactggtgtccgtctaggttggactgttgtccccaaggaacttcttttctcagatggacatccagttgctaaagatttcaaccgcatagtctgcacttgcttcaatggcgcatcaaacattgctcaagctggtggcttagcttgcctctctacagagggcctgaaggctatgcgtgacgtcgttggcttctacaaggagaacactgaaataattgttgacacatttacatcgcttgggttcaacgtgtatggtgccaagaacgctccttacgtgtgggtgcacttccctgatcgcaagtcgtgggatgtgttcgctgagatcctcgagaaggcaaacgttgtcactactcctggcagtggatttggaccaggcggcgaaggctttgtgagggtcagtgcattcggccacagagagaacatcattgaagccgctaggagattaaagcatatgtacaaatgagcaccgacgcaacttctgtatcgcacttgaaggactgtaccaataagatcacagctggatttggaatgccaaatcctctctttggagctaccaggagatattagaagtgatacttgataatttcgtaggctttttttttaatggtgttactccattcaaaccatttccattttgaaataatgctttgtatacctgaggcgtttaaatcaccaatggttatat

SEQ ID NO: 664 - protein, 463 aa, Panicum virgatum
  misc_feature (93)..(458): Pfam Name: Aminotran_1_2 Pfam Description: Aminotransferase class I and II
  misc_feature: Ceres Clone ID no. 1781022
  misc_feature: Bit score of 1192.3 for HMM based on sequences of Figure 5
  misc_feature: Functional Homolog Of SEQ ID NO. 645
MAAAPTGGPAITMSSSSFLSPSPFYVKASRTSHRRPARRMPVTVRCVSSPPAADTAHKTSVPRNANMTKLQAGYLFPEIARRRAAHLLKYPDAEIISLGIGDTTEPIPDVITNAMAERAHALSTIDGYSGYGAEQGEKKLRAAIAATYYADLGIEDSDIFVSDGAKCDISRLQVLFGSNVTIAVQDPSYPAYVDSSVIMGQTDLYQQDVQKYGNIEYMRCNPENGFFPDLSTVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNIAQAGGLACLSTEGLKAMRDVVGFYKENTEIIVDTFTSLGFNVYGAKNAPYVWVHFPDRKSWDVFAEILEKANVVTTPGSGFGPGGEGFVRVSAFGHRENIIEAARRLKHMYK

SEQ ID NO: 665 - DNA, 1612 bp, Triticum aestivum
  misc_feature: Ceres Clone ID no. 618639
  misc_feature: Encodes the peptide sequence at SEQ ID NO. 666
actgatttccccctccacctatctacccgccgccgccacgcccgccgccgacgacgatggcaactaccgcctcaccctccaccacgaccaccccccggtccttcctctcgtcgccttccttctccctcagggcatcgaagtcgagccacctccggacgacgagaaggctgcccgttaatgtacgctgcgccagtagctctccggccgccgatacatcttacacgacgaaggtctcgcggaatgccaacatagccaagctccaagcaggctatttgtttccggagattgccagaagaagggcagctcatctgctaaagcatcctgacgccaaaattataagtctgggaataggtgacactactgagcccattccggaggtcataacaaatgccatggcagagagagcacatgctttatccacagtggatggctacagtggttatggagctgaacaaggtgaaaagaaactaagggcagcaattgctgcaacctactatgcggatcttggtattgacgaaactgatatatttgtctctgatggtgccaaatgtgacatttctcgcctacaggttctttttggatctaaagtgaagattgcagttcaagatccatcatatcccgcatatgttgattcaagtgttatcatggggcaaactgacttatatcagcaggatgttcagaagtatggaaatattgaatacatgagatgcagtcctgaaaatggatttttccctgatctttccaaggtcccacggacagatatcatattcttctgttcacccaacaatcctactggtgctgctgcatctagggaccagctaacacagttggtcaaattcgcaaaggacaatgggtccataatagtctatgattctgcttatgccatgtacatatcagatgacagcccaaaatccatctttgaaattcctggggcgaaggaggttgccctcgagacagcatctttctctaaatatgctgggttcactggtgtccgactgggttggactgtggtccctaaggagctccttttctccgatgggcatccagtcgctaaagatttcaaccgcatagtctgcacttccttcaatggcgcatcgaccatctctcaggccggtggtttaggctgcctctctccagagggtctaaaggctatgcaagacgttgtcggattctacaaggagaacaccaaaatcattgtcgacacgtttgagtcgctcggattcaacgtctacggtgcgaagaatgccccctatgtgtgggtgcacttccctgaccgcaattcctgggatgtctttgccgagatccttgagaaggcaaacgtggtcactactcccggcagtggatttgggcccggcggtgagggctttgtgagggtcagtgcatttggccacagagagaacattattgaagctgcgagaagactgaagcagctatacaaatgagcgttggtttagcaggtggccccctctgtcgctggggagccaggcaataagaacccagcagcatttggagcacgaggtttgcttctcggctgctgggaagtgttagaatagagacagggtgttgtttttgctccattcgtaaccatttaatactggaaatttgcttgttc

SEQ ID NO: 666 - protein, 461 aa, Triticum aestivum
  misc_feature (91)..(456): Pfam Name: Aminotran_1_2 Pfam Description: Aminotransferase class I and II
  misc_feature: Ceres Clone ID no. 618639
  misc_feature: Bit score of 1169.6 for HMM based on sequences of Figure 5
  misc_feature: Functional Homolog Of SEQ ID NO. 645
MATTASPSTTTTPRSFLSSPSFSLRASKSSHLRTTRRLPVNVRCASSSPAADTSYTTKVSRNANIAKLQAGYLFPEIARRRAAHLLKHPDAKIISLGIGDTTEPIPEVITNAMAERAHALSTVDGYSGYGAEQGEKKLRAAIAATYYADLGIDETDIFVSDGAKCDISRLQVLFGSKVKIAVQDPSYPAYVDSSVIMGQTDLYQQDVQKYGNIEYMRCSPENGFFPDLSKVPRTDIIFFCSPNNPTGAAASRDQLTQLVKFAKDNGSIIVYDSAYAMYISDDSPKSIFEIPGAKEVALETASFSKYAGFTGVRLGWTVVPKELLFSDGHPVAKDFNRIVCTSFNGASTISQAGGLGCLSPEGLKAMQDVVGFYKENTKIIVDTFESLGFNVYGAKNAPYVWVHFPDRNSWDVFAEILEKANVVTTPGSGFGPGGEGFVRVSAFGHRENIIEAARRLKQLYK

SEQ ID NO: 667 - protein, 461 aa, Populus balsamifera subsp. trichocarpa
  misc_feature (91)..(456): Pfam Name: Aminotran_1_2 Pfam Description: Aminotransferase class I and II
  misc_feature: Public GI ID no. 118483001
  misc_feature: Bit score of 1195.3 for HMM based on sequences of Figure 5
  misc_feature: Functional Homolog Of SEQ ID NO. 645
MSPTQLLSTSISSSSSAFLAAPIAFKARNQNVSIASKTPSICTCAAAPQEQKTVYKTQVSRNANIAKLQAGYLFPEVARRRNAHMLKYPDAKVISLGIGDTTEPIPEVITSAIAKRAEALSTLEGYGGYGPEQGEKPLRTAIASTFYSGLGIEEDDIFVSDGAKCDISRLQMVFGANVTMAVQDPSYPAYVDSSVIMGQTGQFQKDIEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEGFVRVSAFGHRENVLEACRRFKQLYN

SEQ ID NO: 668 - DNA, 1582 bp, Arabidopsis thaliana
  misc_feature: Ceres Clone ID no. 38404
  misc_feature: Encodes the peptide sequence at SEQ ID NO. 669
aggttcatttgctctgcaaatttgtctgaaaaaatctttgtgcgaatcaggaaaaatgtcgtcgacccatcagttagtttcttcgatgatctcttcttcctcatccactttcttagccccttcaaattttaatctcagaactcgaaatgcttgcttacccatggcaaaacgggtcaatacttgcaaatgtgttgctacgccgcaagagaagatcgagtataagaccaaagtgtcacggaattcaaacatgtccaaacttcaggctggatacctattcccggagattgcaagaagaaggtctgcacacttgttgaaatatccagatgcacaagttataagtcttggaataggcgacacaactgagccaattcctgaagtgatcacttctgctatggcaaagaaagctcatgagttgtcaacaatagagggatatagtggttatggtgctgaacaaggtgcaaagccactgagagctgctattgcgaaaacattctacggtggccttggcataggggatgatgacgtttttgtttctgatggagctaaatgtgatatctcacgtctccaggttatgtttggttccaatgttacaattgctgttcaggatccttcatatccggcttatgtggactccagtgttattatgggtcagactgggcaatttaacactgatgtgcaaaagtatggaaacatcgagtacatgagatgcactccagagaatggcttctttcccgacttgtccaccgttggcgggacagatataattttcttctgttccccaaataaccctacgggtgctgctgccacgagagagcaactaacgcagttagttgagtttgcaaagaagaacggttctataatagtgtatgattccgcctatgcaatgtacatgtctgatgataacccacgatccatcttcgaaatccctggagcagaggaggtcgctatggagacagcttcgttcagcaaatatgctggtttcactggagttcgacttggttggactgtcatcccgaaaaagctactctattcagacggtttccctgttgccaaagacttcaatcggattatctgcacttgtttcaatggtgcatctaatatctctcaagctggtgctcttgcttgccttacacccgaaggacttgaggcaatgcataaggtgattggattctataaagaaaacacaaacataatcattgacacattcacatctctcgggtatgatgtatatggaggaaagaatgcgccttacgtatgggttcacttcccgaaccaaagctcatgggatgtgtttgctgagattctggagaagactcatgtggttacaactccaggaagtgggtttggaccagggggtgaagggttcgttcgtgtcagtgcctttggtcacagagagaacatcttagaggcatgtcgaagattcaagcagctttacaaatgaagaaccttgtttgtaatcgttcctcatcatcatcaccctctttaatgacatgatttgagttaaaataatgtcgtttccattgttttctggaatttgtagaagacacttttgacaccagtgtttcaagcaatttggcaaagc

SEQ ID NO: 669 - protein, 461 aa, Arabidopsis thaliana
  misc_feature (91)..(456): Pfam Name: Aminotran_1_2 Pfam Description: Aminotransferase class I and II
  misc_feature: Ceres Clone ID no. 38404
  misc_feature: Bit score of 1204.4 for HMM based on sequences of Figure 5
  misc_feature: Functional Homolog Of SEQ ID NO. 645
MSSTHQLVSSMISSSSSTFLAPSNFNLRTRNACLPMAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGGTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYK

SEQ ID NO: 670 - protein, 426 aa, Arabidopsis thaliana
  misc_feature (56)..(421): Pfam Name: Aminotran_1_2 Pfam Description: Aminotransferase class I and II
  misc_feature: Public GI ID no. 3549670
  misc_feature: Bit score of 1114.7 for HMM based on sequences of Figure 5
  misc_feature: Functional Homolog Of SEQ ID NO. 645
MAKRVNTCKCVATPQEKIEYKTKVSRNSNMSKLQAGYLFPEIARRRSAHLLKYPDAQVISLGIGDTTEPIPEVITSAMAKKAHELSTIEGYSGYGAEQGAKPLRAAIAKTFYGGLGIGDDDVFVSDGAKCDISRLQVMFGSNVTIAVQDPSYPAYVDSSVIMGQTGQFNTDVQKYGNIEYMRCTPENGFFPDLSTVGRTDIIFFCSPNNPTGAAATREQLTQLVEFAKKNGSIIVYDSAYAMYMSDDNPRSIFEIPGAEEVAMETASFSKYAGFTGVRLGWTVIPKKLLYSDGFPVAKDFNRIICTCFNGASNISQAGALACLTPEGLEAMHKVIGFYKENTNIIIDTFTSLGYDVYGGKNAPYVWVHFPNQSSWDVFAEILEKTHVVTTPGSGFGPGGEGFVRVSAFGHRENILEACRRFKQLYK

SEQ ID NO: 671 - protein, 464 aa, Oryza sativa subsp. japonica
  misc_feature (94)..(459): Pfam Name: Aminotran_1_2 Pfam Description: Aminotransferase class I and II
  misc_feature: Public GI ID no. 37703720
  misc_feature: Bit score of 1198.2 for HMM based on sequences of Figure 5
  misc_feature: Functional Homolog Of SEQ ID NO. 645
MAASPAAAAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAERAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 672 - protein, 432 aa, Arabidopsis thaliana
  misc_feature (56)..(421): Pfam Name: Aminotran_1_2 Pfam Description: Aminotransferase class I and II
  misc_feature: Public GI ID no. 152149571
  misc_feature: Bit score of 1077.2 for HMM based on sequences of Figure 5
  misc_feature: Functional Homolog Of SEQ ID NO. 645
  misc_feature (30)..(30): Xaa is any aa, unknown, or other
  misc_feature (78)..(78): Xaa is any aa, unknown, or other
  misc_feature (138)..(138): Xaa is any aa, unknown, or other
  misc_feature (162)..(162): Xaa is any aa, unknown, or other
  misc_feature (181)..(181): Xaa is any aa, unknown, or other
  misc_feature (242)..(242): Xaa is any aa, unknown, or other
  misc_feature (244)..(244): Xaa is any aa, unknown, or other
  misc_feature (263)..(263): Xaa is any aa, unknown, or other
  misc_feature (331)..(331): Xaa is any aa, unknown, or other
MAKRVNTCKCVATPQEKIEYKTKVSRNSNXSKLQAGYLFPEIARRRSAHLLKYPDAQVISLGIGDTTEPIPEVITSAXAKKAHELSTIEGYSGYGAEQGAKPLRAAIAKTFYGGLGIGDDDVFVSDGAKCDISRLQVXFGSNVTIAVQDPSYPAYVDSSVIXGQTGQFNTDVQKYGNIEYXRCTPENGFFPDLSTVGRTDIIFFCSPNNPTGAAATREQLTQLVEFAKKNGSIIVYDSAYAXYXSDDNPRSIFEIPGAEEVAXETASFSKYAGFTGVRLGWTVIPKKLLYSDGFPVAKDFNRIICTCFNGASNISQAGALACLTPEGLEAXHKVIGFYKENTNIIIDTFTSLGYDVYGGKNAPYVWVHFPNQSSWDVFAEILEKTHVVTTPGSGFGPGGEGFVRVSAFGHRENILEACRRFKQLYKHHHHHH

SEQ ID NO: 673 - protein, 439 aa, Oryza sativa subsp. japonica
  misc_feature (69)..(434): Pfam Name: Aminotran_1_2 Pfam Description: Aminotransferase class I and II
  misc_feature: Public GI ID no. 125603687
  misc_feature: Bit score of 1136.6 for HMM based on sequences of Figure 5
  misc_feature: Functional Homolog Of SEQ ID NO. 645
MAASPAAGAAAATVSSFVSPSSFSSVNFRFEAFKTKVPRNANMAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 674 - protein, 397 aa, Oryza sativa subsp. japonica
  misc_feature (27)..(392): Pfam Name: Aminotran_1_2 Pfam Description: Aminotransferase class I and II
  misc_feature: Public GI ID no. 108707679
  misc_feature: Bit score of 1033.3 for HMM based on sequences of Figure 5
  misc_feature: Functional Homolog Of SEQ ID NO. 645
MAKLQAGYLFPEIARRRAAHLLKFPDAKIISLGIGDTTEPIPDVITNAMAKRAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 675 - protein, 419 aa, Vitis vinifera
  misc_feature (49)..(414): Pfam Name: Aminotran_1_2 Pfam Description: Aminotransferase class I and II
  misc_feature: Public GI ID no. 157352390
  misc_feature: Bit score of 830.2 for HMM based on sequences of Figure 5
  misc_feature: Functional Homolog Of SEQ ID NO. 645
MSATAKCMQMAGVCTRVTRNLNMEKLRNGYLFPEIAMRELEHMKKYPNAKVISLGIGDTTEPIPDIVTSSMANHARRLSTVEGYRGYGAEQGNKALRKAIAETLYGDLPIKDTEIFVSDGSQCDISRLQLLLGSNVTIAVQDPTFPAYIDSSVIIGQTGDFQDETGKYQNIKYMPCRPQNNFFPDLTTTATTDVIFICSPNNPTGHAASRKQLEQLVEFARANRSIIIFDSAYAAYVTDESPRSIFEIPGAREVAIEISSFSKFAGFTGVRLGWTVVPDELLFSNGFPVIKDYNRIVCTCFNGASSIAQAGGLACLSSDGLMVMQSVVDYYKENAKILGDTFTSLGLDVYGGINAPYAWVHFPGMKSWDVFTELLEKTHIITVPGCGFGPGGEEHIRVSAFGHRECILEASRRLKSLLS

SEQ ID NO: 676 - protein, 441 aa, Chlamydomonas reinhardtii
  misc_feature (69)..(433): Pfam Name: Aminotran_1_2 Pfam Description: Aminotransferase class I and II
  misc_feature: Public GI ID no. 159469820
  misc_feature: Bit score of 829.9 for HMM based on sequences of Figure 5
  misc_feature: Functional Homolog Of SEQ ID NO. 645
MQLNVRSTASGARSSTRSRRMTAVVQAVAQRAGTIDVQRNENFGKLRAGYLFPEIARRRKAHQEKNPDAKIISLGIGDTTEPLPKYIADAMAKAAAGLATREGYSGYGAEQGQGALREAVASTFYGHAGRAADEIFISDGSKCDIARIQMMFGSKPTVAVQDPSYPVYVDTSVMMGMTGDHNGTGFDGIEYMVCNPDNHFFPDLSKAKRTDIIFFCSPNNPTGAAATRAQLTELVNFARKNGSILVYDAAYALYISNPDCPKTIYEIPGADEVAIETCSFSKYAGFTGVRLGWTVVPKALKYANGEPVHADWNRVMTTCFNGASNIVQAGGLACLQPEGLKEMNAMIKFYKENAQILKTTFTEMGFSVYGGDDAPYIWVGFPGKPSWDVFAEILERCNIVTTPGSGFGPAGEGFVRASAFGSRENILEAVRRFKEAYGKRN

SEQ ID NO: 677 - protein, 402 aa, Ostreococcus lucimarinus CCE9901
  misc_feature (27)..(396): Pfam Name: Aminotran_1_2 Pfam Description: Aminotransferase class I and II
  misc_feature: Public GI ID no. 145344081
  misc_feature: Bit score of 639.3 for HMM based on sequences of Figure 5
  misc_feature: Functional Homolog Of SEQ ID NO. 645
MAQLKAGYLFPEIARIRNAHLEKNPDAKIISLGIGDTTEPIPKPITDGMVAAAAALGTKEGYSAKGGYGPEAGQMELRKTIAEKLYKGTPITYEDVFASDGSKCDISRMLQMFGSGRKIAVQDPSYPAYVDSSVIMGHSTGFNDAVKQYENITYMPCGAENDFFPDLSAAKSAELIFFCSPNNPTGAAATRAQLTELVNQALESGSIIIYDAAYSAFVGNPDCPKTIYEIPGAEKCAIETCSFSKYAGFTGLRLGWTVFPEALKFSDGSSVRQDWTRMMGTSFNGASTVAQGAGLACLTDAGLAAMGDMVAFYKENAAILKRTWEEMGYKVYGGTDAPYVWVSFEGRDSWEVFTEILDKTDIVTTPGAGFGPAGNGYVRCSAFGSRENINEAARRLKESFSK

SEQ ID NO: 678 - DNA, 708 bp, Oryza sativa subsp. japonica
  misc_feature: Antisense of Os01g58420 relative to construct 5' to 3'
ctagttctctaccggcggcggccggttcagatccagatcgaaagctgccgccttgttcgccgtaaccgctggaggtgacggcgcgagatcaaccaccgacgaggagtcggagtcactttgtgcaaccgccgccacggtgaccggcggtgcaagcttcatcatacggtatccagcctcagctgcggcagccgctgcagcctgctcatagaaaaagtaaggatgcgttgctggacgtgcaacgggatatcctctgaaaggaaagcgaacgccggtgccggcgactgcagtcacagcagccgcgcggtggaacaaatccaagtccagagtcggcggcagaggcatggcccgcataggcgtctgaaccccgccgccaccggtgtctaccgtgctattgctgctggggctgccgccacagccgaccatcgactgtgatgcaaacggaaagtttgtttttgccttggcaccccggaactctcgagcggcggcgtcgtaggcgcgggcggcctcctctgccgtgtcgtaggtaccgagccacacccggctcttcttggcagggtcacggatctccgctgcgtaacgcccccacgggcgcttgcggacgcccctgtagtgaggacccccggctccgacacctccgccgacgccaagaccaagcccggtgggtggcgccacagcaaccttctccaccgtagctgctctgggcgccat

SEQ ID NO: 679 - DNA, 495 bp, Arabidopsis thaliana
  misc_feature: Ceres Annot ID no. 832857
  misc_feature: Ceres Locus ID no. AT1G16910
  misc_feature: Encodes the peptide sequence at SEQ ID NO. 243
atgacgagtacaaacacgagaaacaaaggcaaatgcatagtagaaggaccaccaccgactctaagccgttatgagtcacaaaaaagccgcgactggaacacgttttgccagtatctcatgaccaagatgccaccagttcacgtatgggagtgtgaatcaaaccacatcctcgatttcctccaaagtcgtgaccagtttggtaaaacaaaagttcatatccaaggatgcgttttcttcggacagaaagagccaccaggagagtgtaactgcccgttgaaacaggcgtggggaagcttagatgctttgatcggacggctgagagcagcttacgaggagaacggtggcttaacggagaaaaacccgtttgcccggggagggattaggatttttctgagggaagtgagaggttcacaggcgaaggcgagaggagttttgtacaaaaaaaagaagcgtcttgtagttgttggtacgggaactagtactacttggacttaa

SEQ ID NO: 680 - DNA, 1003 bp, Arabidopsis thaliana
  misc_feature: Ceres Annot ID no. 870022
  misc_feature: Ceres Locus ID no. AT1G78815
  misc_feature: Encodes the peptide sequence at SEQ ID NO. 244
aagaccaaaagaaaaaaaaaaactttttcttttctgatgaatcgtatctattagctatgagcctgaggtgatgatcatgtcaacataaccatcaacgttctaccatggctagtcatagcaacaaaggcaaaggcatagcagaaggatcgtctcaaccgcaatcgcaaccgcaaccacaaccacaccaaccgcaatcacctcctaacccgccagcgttaagccggtacgagtcacagaaacgacgagactggaacacgttttgtcaatacctgcgtaaccaacagccaccggttcacatctcgcagtgtggatcaaaccacatcctcgatttcctccaatatctcgaccagtttgggaagacaaaggttcatatccatggatgcgttttcttcggacaggttgagccagcgggacagtgtaactgtcctttaaaacaagcgtgggggagtttagatgctttgatcggacggctaagagcggctttcgaggagaacggaggattgccggagagaaacccttttgccggcggcggaattagggtttttctgagggaagtgagagattcacaggcgaaggcaagaggagttccgtacaagaaaagaaaaaagaggaagaagaggaatcctatgaagagtcatgatggtgaagatggtactacgggaactagtagtagctccaacttggcttcttagcggaagcaaacaaaaaatctataataaaacaaagtggaattagttaatggtaagcatttaatactctccataatctctattaattttcagtactttaatcctattttgtgatctatttacaattttacatatagagtgaaaagaaacaattctacattcgtttcttgatagtcagctcttaatgcatagttgaattttatacgtatcatacccaaactataagattaatcttgatcttagatcatatacatatatcatcatggtgtgtaccctaagtttcataatcatttttcttaactatttatgtggat

SEQ ID NO: 681 - DNA, 660 bp, Arabidopsis thaliana
  misc_feature: Ceres Annot ID no. 828846
  misc_feature: Ceres Locus ID no. AT2G31160
  misc_feature: Encodes the peptide sequence at SEQ ID NO. 245
atggatatgattccccaattgatggaaggctcttcagcttacggaggtgtcacaaacctcaacatcatctcaaacaactcctcctccgtcaccggagccaccggaggtgaagcaacgcaaccactgtcttcctcctcctcaccatcggcgaactcaagccgttacgagaaccagaagaggagagactggaacacgttcggacagtacttaaggaaccatcggccaccgctttcgctttcccgatgcagtggagctcacgtgctcgagttcctccgttacttggaccagttcggtaagacaaaagtccacacgaacatttgtcacttctatggccatcctaatcctccggcaccgtgtccgtgtcctctccgacaagcttggggaagtcttgacgctcttatcggtcgtcttcgagctgcctttgaggaaaacggaggcaagcctgagacgaatccttttggagctcgtgccgttaggctttatctaagggaagttagagatatgcagagtaaagctagaggtgttagctacgagaagaagaagcgaaagcgtcctcttccttcgtcgtcgacttcttcttcctccgccgtagctagccaccagcaatttcaaatgctaccgggtactagttctactactcaattaaagtttgagaagtaa

SEQ ID NO: 682 - DNA, 907 bp, Arabidopsis thaliana
  misc_feature: Ceres Annot ID no. 861920
  misc_feature: Ceres Locus ID no. AT2G42610
  misc_feature: Encodes the peptide sequence at SEQ ID NO. 246
attacataattcttcagatccataaaacaaattgatcccttaaccttcttcaccaacatctctcttacactcaacaagagatcatatcatgtcctctccaagagaaagaggaaagagtttgatggaatcatcaggatcagagccaccggtgacaccaagccgttacgagtcgcagaagagacgtgactggaacactttcggacagtacttgaagaatcagagaccgcctgtgccgatgtctcactgcagctgtaaccacgtgcttgatttcctcaggtacttagaccagttcggtaagacaaaggtgcacgtgcctggctgtatgttctacggccagcctgagccaccagctccttgcacgtgccctctcagacaagcttggggaagtcttgacgctttgatcggacggctgagagcggcttacgaggagaacggtggacctccggagactaaccctttcgctagcggagcgataagggtttatctgagggaggttagggagtgtcaggctaaggctagagggattccttacaagaagaagaagaagaagaagccaacgccggagatgggaggtgggagagaggactcttcttcctcctcctcttccttcagcttctcttaagagattctccatcgtcgtgaaagactttgtggatcagtaagtctcaaagagggatcaaatgtaaaagagacctcaaatctatctactggtatcttcaacatatctttcgggaccatttttgcagctcttcgtcccctcctcttcatttccgcagatctccgtcgtcataaatatcttcatctattctcttattaagctctattcatatttattctcttattaagcacttttcttttgaataaagtaagtgtaaagagtttatatattgaattcaggtgtgttttg

SEQ ID NO: 683 - DNA, 606 bp, Arabidopsis thaliana
  misc_feature: Ceres Annot ID no. 839537
  misc_feature: Ceres Locus ID no. AT3G04510
  misc_feature: Encodes the peptide sequence at SEQ ID NO. 247
atggatttgatctctcaaaaccacaacaacagaaaccctaataccagtctctcgacgcaaaccccttcttccttttcttctccaccttcctctagccgctacgagaaccagaaacgccgtgactggaacactttctgccaatacctcagaaaccaccatccaccgctctctctagcttcttgcagtggcgcacacgtcctcgattttctgcgttaccttgaccaattcggcaaaaccaaagtccaccaccaaaactgcgccttctttggcctcccaaatccaccggctccttgtccttgtcctctccgacaagcctggggctcactcgacgccctcattggtcgtctccgtgcagcctacgaggagaacggtggcgctcccgagactagcccttttggctcacggtccgtcaggattttcctcagggaggttagagatttccaggctaagtcacgtggtgttagctatgagaagaagaggaaaagggtcaacaacaagcaaataactcagtcccaaccacagtcccaaccgcctttaccccagcagccacagcaggagcaaggtcagtctatgatggctaattaccaccacggtgcaactcaataa

SEQ ID NO: 684 - DNA, 588 bp, Arabidopsis thaliana
  misc_feature: Ceres Annot ID no. 8755109
  misc_feature: Ceres Locus ID no. AT3G23290
  misc_feature: Encodes the peptide sequence at SEQ ID NO. 248
atggatcatatcatcggctttatgggcacaacaaacatgtcacataacacaaaccttatgatcgctgccgcagccactaccactacgacctcttcgtcttcctcttcgtcctccggaggctcggggactaaccagctaagcaggtacgagaatcagaagagaagagattggaacactttcggacagtatctacgcaatcaccgtccaccactttctctctcccgttgcagtggtgctcatgttcttgaattcctcaggtacctcgaccaattcggcaagactaaggttcacacacacctatgtccgttcttcggacacccaaacccaccagcaccatgtgcctgtccactccgacaagcgtggggtagtctggacgcactcattggccgtcttagagctgcttttgaagagaacggtggttcaccagagacgaacccttttggtgcacgagccgttcgactctacctaagggaagtacgtgactcgcaggctaaagcacgtgggatcagctatgaaaaaaagaagcgcaagcgacctcctccgccactaccaccggctcagccggcgatttcaagtagccctaattaa

SEQ ID NO: 685 - DNA, 573 bp, Arabidopsis thaliana
  misc_feature: Ceres Annot ID no. 853637
  misc_feature: Ceres Locus ID no. AT5G28490
  misc_feature: Encodes the peptide sequence at SEQ ID NO. 249
atggatttgatctctcaccaaccaaacaagaaccctaattcctcaacacaactaacaccaccttcctcaagccggtacgagaaccaaaaacgccgtgactggaacactttctgtcaatacctccggaaccaccgtcctccgctctctctcccctcgtgtagcggcgcacacgtgctcgagttcctccgctaccttgaccagttcgggaaaacaaaagttcaccaccagaactgtgccttctttggcctccctaaccctcctgctccttgtccttgtcctctccggcaagcttggggctcactcgacgctcttatcggccgcctccgcgccgcctacgaggagaacggtggcccacctgaagctaacccatttggctcacgcgccgtcaggttattcctccgtgaagtcagagactttcaagccaaagctcgaggtgttagctatgagaagaagaggaagagagtcaacaggcagaaaccgcaaacgcagccgcctctacagcttcagcaacagcaacagcagccacaacaaggtcagtctatgatggctaattactcgggtgcaacagtatga

SEQ ID NO: 686 - DNA, 549 bp, Arabidopsis thaliana
  misc_feature: Ceres Annot ID no. 856813
  misc_feature: Ceres Locus ID no. AT5G58500
  misc_feature: Encodes the peptide sequence at SEQ ID NO. 250
atggagggagaaaccgcagccaaagcagcggcaagttcctcctcatccccgagccggtacgagtctcaaaagaggcgagactggaacactttccttcagtatctaaggaaccacaagccacctctgaatctgtctcgttgtagtggcgcacacgtccttgagttccttaagtacctcgaccagtttggtaagaccaaagtccatgccacggcttgtcccttcttcggacaacctaacccaccgtctcagtgcacttgccctctcaagcaagcttggggaagtctcgatgctctcatcggccgtctaagggctgctttcgaggaaatcggcggtggtcttcctgagtcaaaccctttcgctgccaaggctgttaggatctatcttaaagaagtccgtcaaacacaggctaaggctcgagggattccttacgacaagaagaaaagaaaacgtccgcatacagacacggcaactccaatcgccggtgacggagacgatgccgaaggaagtggtggtgctgctttggtcgttacggctgcaactacggtatag

SEQ ID NO: 687 - DNA, 815 bp, Arabidopsis thaliana
  misc_feature: Ceres Clone ID no. 28780
  misc_feature: Ceres Locus ID no. AT1G07090
  misc_feature: Encodes the peptide sequence at SEQ ID NO. 251
aactactaaacactaaattatcaatccgctctcttctcaaaaaaaaaaaatcgactctaaaatcaaactctctcaaagctccccaaaaaaaccctagttctgaatggaatcggcggattccggacgatccgatccggtaaaaggagacgacccgggtccatctttcgtctcttcaccaccagctacacctagcaggtatgagtcacagaagcgacgcgactggaacacgttcttgcagtacctcaagaaccacaagccgcctctcgcgttgtcacggtgtagcggagcgcatgtgatcgagtttctcaagtacctcgaccagttcggtaagaccaaagtccacgtggcggcttgtccttacttcggccatcagcaacctccgtctccttgctcatgccctctcaagcaagcttggggatctctcgatgctttgatcggacggttgagagctgcctacgaggagaacggtggacggccggattctaacccgttcgccgcacgtgcggttcggatttacttgagggaagtcagagagagtcaggcaaaggctcgtgggattccttacgagaaaaagaaacggaaacggccgccaactgtcaccaccgttagagttgacgtcgcttcttcgagacaaagtgacggagacccttgtaacgtcggtgctccatctgttgccgaggccgtaccgccttagatcgaattatatataatattatagttttcttgattaatgatatatatatacttatctctatgtatgtatggaactcacttcatcttttgttccttagtacctaattattaaattttgttcc

SEQ ID NO: 688 - DNA, 1470 bp, Populus balsamifera
  misc_feature: Ceres Annot ID no. 1461228
  misc_feature: Encodes the peptide sequence at SEQ ID NO. 689
atgtcgccgacgcaacttttatcgacttcgatttcttcttcttcctctgcttttttagccgcacctattgccttcaaagctagaaaccagaatgtttcgatcgcgtcgaaaacgccttctatttgcacgtgtgctgctgctcctcaagaacagaaaaccgtttacaaaacacaagtctcccgcaatgcaaatattgcaaagcttcaagctggttacttatttccagaggttgctcgaaggaggaatgcgcacatgctgaaataccctgatgcaaaagtgataagccttggaattggtgacactacagaacctatcccagaagttataacttctgcaatagcaaagagagcagaagcactgtctactttggagggttacagtggttatggacctgaacaaggtgaaaaacctttgagaactgcaattgcttcaacattttattcaggtcttgggatcgaggaggatgatatatttgtctctgatggtgccaaatgtgacatatctcgcctccagatggtatttggggcaaatgtaaccatggcagtgcaagatccatcatacccggcttacgttgattctagtgtcatcatgggccagactggacagtttcagaaagacgttgagaagtacggtaagattgaatacatgaggtgcactccagagaatggttttttccctgatttatccaaagtttctcgaacggatatcatatttttctgttcaccgaacaatcctactggttctgctgcaacaagggagcaactgacccaactagtacaatttgcaaaggacaatggatcaatcatcgtctatgattcagcatatgccatgtatatgtctgatgataacccacgatccatatttgaaattccgggagccaaagaggttgctttggagacatcatcttttagtaagtatgctgggtttactggagttcgtctggggtggactgttgttccaaaacagcttctatattctgatgggttcccagttgtaaaggatttcaaccgtgttgtttgcactagctttaatggggcatccaacatttgccaagctggtggtcgggcttgcctttcacctgaaggccttaaggcaatgagtgaggtgattggattctataaagaaaactccaacattataatggatacattcaattcgctcggttttaatgtatatggaggaaagaatgctccctatgtgtgggttcacttccctggccaaagctcgtgggatgttttcagtgaaattcttgagaaaactcatgtagttaccacacctgggagtggttttggacctggtggggaagtttggttagaccaccaaggcagaatattttctgaaaaaacagcaagcccgctcacaacaagctcggactctcgaaaggacaagatctccataaagcagggggagcaaccaagacagccttccagcgatgttagcaatgcaaatctttacacatcaagttggtaa

SEQ ID NO: 689 - protein, 429 aa, Populus balsamifera
  misc_feature (91)..(464): Pfam Name: Aminotran_1_2 Pfam Description: Aminotransferase class I and II
  misc_feature: Ceres Annot ID no. 1461228
  misc_feature: Bit score of 1109.0 for HMM based on sequences of Figure 5
  misc_feature: Functional Homolog Of SEQ ID NO. 645
RNANIAKLQAGYLFPEVARRRNAHMLKYPDAKVISLGIGDTTEPIPEVITSAIAKRAEALSTLEGYSGYGPEQGEKPLRTAIASTFYSGLGIEEDDIFVSDGAKCDISRLQMVFGANVTMAVQDPSYPAYVDSSVIMGQTGQFQKDVEKYGKIEYMRCTPENGFFPDLSKVSRTDIIFFCSPNNPTGSAATREQLTQLVQFAKDNGSIIVYDSAYAMYMSDDNPRSIFEIPGAKEVALETSSFSKYAGFTGVRLGWTVVPKQLLYSDGFPVVKDFNRVVCTSFNGASNICQAGGRACLSPEGLKAMSEVIGFYKENSNIIMDTFNSLGFNVYGGKNAPYVWVHFPGQSSWDVFSEILEKTHVVTTPGSGFGPGGEVWLDHQGRIFSEKTASPLTTSSDSRKDKISIKQGEQPRQPSSDVSNANLYTSSW

SEQ ID NO: 690 - DNA, 819 bp, Arabidopsis thaliana
  misc_feature: Ceres Annot ID no. 827940
  misc_feature: Encodes the peptide sequence at SEQ ID NO. 691
atgtatgaaaacgggataagctttataatctctttacttatatgtggatgtgtgaagagtgaggagatgatgaagcaacatttcgtgctagtacatggttcgtgcctcggcgcgtggtgctggtacaaggtgaagccgctgctcgaggcttcgggccatcgtgtaaccgccttagacctagctgcttgtggtatagacacaaggtcgatcactgacatttccacatgcgaacaatattctgagccgttgattcagctaatgacttcattgccgaatgatgagaaggttgtgctcgtgggtcatagctatggaggtttgactttagccatagccatggataagtttcccgacaaaatctctgtctctgtcttcgtaacttctttcatgcccgacaccaaaaactcaccatcgttcgtcctggaaaagtttgcaagcaccatgacaccagaagattggatgggctctgagctcgagccgtatgtggtcttcagcgctgagttcacgaagcaccgtatcctccaactttctcctattgaagatcttgagcttagattgcttctaaagaggcctggttcattatttcttaatgatttatcgaggatgaagaacttttctgaaaaagggtatggatctgttcctcgagcttacattgtgagcaaagatgaccacaccatctcggaagaatatcaacgatggatgatcgataactatccgccgaatttagtgatagagatggaagggacggatcatttgccattgttttgcaaacctcaactactaagtgaccatctattggcaatcgccgacaaattctcttaa

SEQ ID NO: 691 - protein, 272 aa, Arabidopsis thaliana; identical to SEQ ID NO: 610
  misc_feature (53)..(266): Pfam Name: Abhydrolase_1 Pfam Description: alpha/beta hydrolase fold
  misc_feature: Ceres Annot ID no. 827940
  misc_feature: Bit score of 566.2 for HMM based on sequences of Figure 8
  misc_feature: Functional Homolog Of SEQ ID NO. 595

SEQ ID NO: 692 - DNA, 1743 bp, Sorghum bicolor; identical to SEQ ID NO: 535
  misc_feature: Ceres Annot ID no. 6086224
  misc_feature: Encodes the peptide sequence at SEQ ID NO. 693

SEQ ID NO: 693 - protein, 520 aa, Sorghum bicolor
  misc_feature (103)..(499): Pfam Name: PTR2 Pfam Description: POT family
  misc_feature: Ceres Annot ID no. 6086224
  misc_feature: Bit score of 1335.6 for HMM based on sequences of Figure 11
  misc_feature: Functional Homolog Of SEQ ID NO. 426
VFLRRVLHQGNAEAANNISKWTGTVYIFSLIGAFLSDSYWGRYVTCAIFQIIYVTGLVILSLASWFLLVKPSGCGGVKVHCDEPSAPGVALFYLSTYMIAFGNGGYQPSIATFGSDQFDETDPKEGRSKVAFFSYFYLALNVGSLFSNTVLVYYEDSGRWVMGFWVSAAAAALALVLFLLGTPNYRHFKPSGNPLTRVAQVFVAAFRKWHAEVPRGELLHEVEGEDPKISGIRKILHSDELRFLDKAATITEGEKMENPWRLCTVTQVEEVKCILKMLPIWLCTIVYSVVFTQMASLFVEQGATMDTNIGSFHFPAASMSLFDVLSVLAFIAIYRRVLVPVMARLSGNPQGLTELQRMGVGLVIGMAAMVVAGVVEVERLKRVAAPDQPSSLSVLWQVPQYALIGASEVFMYVGQLEFFNGQAPDGVKSFGSALCMASISLGNYVSIMLVSVVTSLTAGEKRPGWIPGNLNSGHLDRFYFLLAALSLVDLAVYIACAMWYKGIKLDGGDGDDSRKVSAHV

SEQ ID NO: 694 - DNA, 1374 bp, Glycine max
  misc_feature: Ceres Clone ID no. 476769
  misc_feature: Encodes the peptide sequence at SEQ ID NO. 695
agatcaatttgacgagaagaacgaaaaacaaaagaacgcgagagaagctttcttctcttatttttactttgccctcaatgttggatctctgttctccaacactatattagtatactacgaggattcaggaatgtggacaatgggtttcttggtgtccttggcctcagctgttattgccttagtttcatacttagcaggatatcgaaaatatagatatgtaaagggatatgggaatccggtgataagggtagttcaggtgtttgtggccactgttagaaagtggaaggttggtccagccaaggaactccaactttatgaggttgatggtccagaatctgccataaaagggagtagaaagattcatcacagcaatgattttagattcatggacaaggcagcaacaataacggagaaagatgcagttaatctcaagaatcactggcggctatgtactgtaactcaagttgaggaagccaaatgcgtactgagaatgctaccagtttggctatgtactataatttattcagttgtgtttacgcaaatggcttctctttttgtcgagcaaggggatgtgatgaacaacaagataggaaattttcacttgccagcagccagcatgtcagtgtttgatatctgcagtgtccttttatgcactggaatttatcgccaaatccttgttcctctagcaggaagatttagtggcaatcctaggggactaactgagcttcaaagaatgggagttggcctaattattggaatgttagctattcttgcagctggtgccacagagtttgaaaggctcaaacacattacacccggggaaaaggctagttctttgagtatattttggcaaatcccacagtatgttctagttggtgcttcagaagttttcatgtatgtgggtcaactggagttctttaatgggcaagccccagatggcataaaaagctttgggagctcactttgcatggcttcaatttctcttggaaactatgtgagtagcttgctggtgtacatggtgatgggaatcactgcaagaggcgagaatccgggatggattcccaataacttgaatgtggggcacatggataggtttttcttcctcgttgcagtgctaactgctcttgattttgtactctacttattatgtgctcgctggtacaagagcatcaaccttggagatggtgacatgggaagccaagaggacgaggaagtgatcagtaaagtttgattcagttgttttgaattttcatttccttgctaggaatttgtttatcttagtagttttaataaggctgttcaaggatgtcccttttggtgacacaaagcatgaccagttcaattgagagaggattgacaaaatattggtgggat

SEQ ID NO: 695 - protein, 366 aa, Glycine max
  misc_feature (1)..(283): Pfam Name: PTR2 Pfam Description: POT family
  misc_feature: Ceres Clone ID no. 476769
  misc_feature: Bit score of 498.5 for HMM based on sequences of Figure 11
  misc_feature: Functional Homolog Of SEQ ID NO. 426
MWTMGFLVSLASAVIALVSYLAGYRKYRYVKGYGNPVIRVVQVFVATVRKWKVGPAKELQLYEVDGPESAIKGSRKIHHSNDFRFMDKAATITEKDAVNLKNHWRLCTVTQVEEAKCVLRMLPVWLCTIIYSVVFTQMASLFVEQGDVMNNKIGNFHLPAASMSVFDICSVLLCTGIYRQILVPLAGRFSGNPRGLTELQRMGVGLIIGMLAILAAGATEFERLKHITPGEKASSLSIFWQIPQYVLVGASEVFMYVGQLEFFNGQAPDGIKSFGSSLCMASISLGNYVSSLLVYMVMGITARGENPGWIPNNLNVGHMDRFFFLVAVLTALDFVLYLLCARWYKSINLGDGDMGSQEDEEVISKV

SEQ ID NO: 696 - DNA, 1654 bp, Arabidopsis thaliana
  misc_feature: Ceres Clone ID no. 15650
  misc_feature: Encodes the peptide sequence at SEQ ID NO. 697
attatagaatatctaataatgaagaatcggtttcaaaattaataatgactgattataattacattgacaacatgcagggactaataacaattacactcacagcatcgtttcctcaactccacccagcatcatgcaacagccaggacccactcagttgcggcggtccgaataagctccagatcggagttttgctattgggactctgtttcctctccgtagggagtggaggaatacgaccttgtagcatcccttttggggttgatcagtttgaccaacgaactgaggaaggggttaaaggagtggccagtttcttcaactggtattacatgactttcactgtggttctgatcattacgcagaccgtagttgtgtatatccaggatcaagtcagttggattatcggttttagtatccctaccggactcatggctcttgcggttgttatgttttttgccggaatgaagcgttatgtctacgttaaaccagaaggaagtatattctctgggatcgctcaagttatcgtggcagctcgtaagaagcgaaagctgaaacttccggcggaagatgacggcactgtcacctattacgacccagccatcaagtctagcgtgttatccaagttacaccgcagtaaccaattcaggtgtcttgacaaagccgcggtggttatagaaggtgacctaacacccgagggacctcccgcagacaagtggcggttatgcagcgtccaagaagtggaagaagtgaagtgtttgatccgaattgttcctatctggtcggccggaataatctcactcgcggccatgacaacacaaggcactttcacggtctctcaagctttgaaaatggatcgaaacttaggtcctaaattcgagattccggctggttcactctccgtcatctctctcctcacaatcggcatctttcttcccttctacgaccgcgtttttgtaccattcatgcggcgaatcaccggccataaatccggaatcacactcctccaaaggataggaacagggatcgttttcacgatcttttctatgatcgttgcgggcattgtggagcgtatgagacgcatacgctccatcaatgccggagatccaacgggaatgactccaatgtcggtgttttggctttcgccgcagctaattctcatgggactatgtgaagcattcaatatcatcggacaaattgagttcttcaacagtcagtttccagagcacatgagaagtatcgctaattctctcttctctttatcgttcgccggttcgagctaccttagtagtttccttgtgactgtcgttcataaattctccggtgggcatgatcgtccggattggctaaacaagaatctcaacgcgggaaaattggattacttctattatctgattgcggttttgggtgtggttaatctggtttacttttggtattgtgctcggggataccggtacaaggtcggtttaccgattgaagactttgaggaggacaagtcctccgatgatgttgagatgacttccaagaaatcgatggaatgatttaatagactatccttagggacaacaagaagattgtcgatgttgtttgaataattactatgacaatgtatgtatcataatatgtaagaactagaatatataataaatttttaccttcc

SEQ ID NO: 697 - protein, 496 aa, Arabidopsis thaliana
  misc_feature (13)..(406): Pfam Name: PTR2 Pfam Description: POT family
  misc_feature: Ceres Clone ID no. 15650
  misc_feature: Bit score of 341.4 for HMM based on sequences of Figure 11
  misc_feature: Functional Homolog Of SEQ ID NO. 426
MTDYNYIDNMQGLITITLTASFPQLHPASCNSQDPLSCGGPNKLQIGVLLLGLCFLSVGSGGIRPCSIPFGVDQFDQRTEEGVKGVASFFNWYYMTFTVVLIITQTVVVYIQDQVSWIIGFSIPTGLMALAVVMFFAGMKRYVYVKPEGSIFSGIAQVIVAARKKRKLKLPAEDDGTVTYYDPAIKSSVLSKLHRSNQFRCLDKAAVVIEGDLTPEGPPADKWRLCSVQEVEEVKCLIRIVPIWSAGIISLAAMTTQGTFTVSQALKMDRNLGPKFEIPAGSLSVISLLTIGIFLPFYDRVFVPFMRRITGHKSGITLLQRIGTGIVFTIFSMIVAGIVERMRRIRSINAGDPTGMTPMSVFWLSPQLILMGLCEAFNIIGQIEFFNSQFPEHMRSIANSLFSLSFAGSSYLSSFLVTVVHKFSGGHDRPDWLNKNLNAGKLDYFYYLIAVLGVVNLVYFWYCARGYRYKVGLPIEDFEEDKSSDDVEMTSKKSME

SEQ ID NO: 698 - protein, 4 aa, Artificial Sequence
  C-terminal sorting signal
KDEL

SEQ ID NO: 699 - protein, 4 aa, Artificial Sequence
  C-terminal sorting signal
  VARIANT 3, 4: Xaa = Any Amino Acid
KKXX

SEQ ID NO: 700 - protein, 4 aa, Artificial Sequence
  C-terminal sorting signal
NPIR

SEQ ID NO: 701 - protein, 5 aa, Artificial Sequence
  C-terminal sorting signal
  VARIANT 3: Xaa = Any Amino Acid
LPXTG

What is claimed is:

1. A method of producing a rice plant, said method comprising growing a rice plant cell comprising an exogenous nucleic acid, said exogenous nucleic acid comprising a regulatory region operably linked to a polynucleotide sequence,
   wherein the polynucleotide sequence comprises a nucleotide sequence that encodes a polypeptide having 95 percent or greater sequence identity to the amino acid sequence of SEQ ID NO: 209,
   producing a rice plant from said rice plant cell, and
   selecting the rice plant for having an increased panicle weight of at least 16.4% or an increased plant height of at least 5.66% as compared to the corresponding panicle weight or plant height of a control rice plant that does not comprise said exogenous nucleic acid.

2. The method of claim 1, wherein said polypeptide comprises the amino acid sequence SEQ ID NO:209.

3. A transgenic rice plant or a progeny thereof, wherein the transgenic rice plant or progeny thereof comprises an exogenous nucleic acid, said exogenous nucleic acid comprising a regulatory region operably linked to a nucleotide sequence, wherein the nucleotide sequence encodes a polypeptide having 95 percent or greater sequence identity to the amino acid sequence of SEQ ID NO: 209,
   wherein the transgenic rice plant or progeny thereof is selected for having an increased panicle weight of at least 16.4% or an increased plant height of at least 5.66% as compared to the corresponding panicle weight or plant height of a control rice plant that does not comprise said exogenous nucleic acid.

4. The transgenic plant of claim 3, wherein said polypeptide comprises the amino acid sequence SEQ ID NO: 209.

5. A seed product comprising embryonic tissue from the transgenic rice plant according to claim 4, wherein the seed product comprises the exogenous nucleic acid.

6. The method of claim 1, wherein the polynucleotide comprises the nucleotide sequence of SEQ ID NO:208.

7. The method of claim 1, wherein the polypeptide has 97 percent or greater sequence identity to SEQ ID NO:209.

8. The transgenic rice plant of claim 3, wherein the polynucleotide comprises the nucleotide sequence of SEQ ID NO:208.

9. The transgenic rice plant of claim 3 or a progeny thereof, wherein the transgenic rice plant or progeny thereof comprises the exogenous nucleic acid and wherein the polypeptide has 99 percent or greater sequence identity to SEQ ID NO:209.

10. The transgenic rice plant of claim 3, wherein the polypeptide has 97 percent or greater sequence identity to SEQ ID NO:209.

11. A seed producing the transgenic rice plant of claim 3, wherein the seed comprises the exogenous nucleic acid.

* * * * *